United States Patent 9,139,621 (NEISSERIA MENINGITIDIS ANTIGENS AND COMPOSITIONS) - sequence listing, part 2

SEQ ID NO: 601 - DNA, 2277 bp, Neisseria gonorrhoeae
atggcacaaatcacactcaaacccattgttttatcaattcttttaatcaacacacccctcctcgcccaagcgcatgaaactgagcaatcggtgggcttggaaacggtcagcgtcgtcggcaaaagccgtccgcgcgcgacttcggggctgctgcacacttcgaccgcctccgacaaaatcatctccggcgatactttgcgccaaaaagccgtcaacttgggcgacgctttggacggcgtaccgggcatccacgcttcgcaatacggcggcggcgcatccgctcccgttattcgcggtcaaacgggcagacggattaaagtattgaaccatcacggcgaaacgggcgatatggcggacttttctcccgatcacgccattatggtagataccgccttgtcgcaacaggttgaaatcctgcgcgggccggttacgctcttgtacagctcgggcaatgtggcggggctggtcgatgttgccgatggaaaaatccccgaaaaaatgcctgaaaacggcgtatcgggcgaagccggattgcgtttgagcagcggcaatttagaaaaactgacatccgcaggcatcaatatcggactgggcaaaaacttcgtgctgcataccgaaggcttgtaccgcaaatcgggcgattacgccgtaccgcgttaccgcaatctgaaacgcctgcccgacagccatgccgattcgcaaacgggcagcatcgggctgtcttgggtgggcgaaaaaggctttatcggcgcagcatacagcgaccgtcgcgaccgctacggcctgcctgcccacagccacgaatacgatgattgccacgccgacatcatctggcaaaagagtttgatcaacaaacgctatttgcagctttatccgcacttgttgaccgaagaagacatcgattacgacaatccgggcttgagctgcggcttccacgacggcgacggtgcacacgcacacacccacaacggcaaaccgtggatagacctgcgcaacaaacgctacgaactccgcgccgaatggaagcagccattccccggttttgaagccctgcgcgtacatctgaaccgcaatgactaccaccacgacgaaaaagcaggcgatgcagtagaaaacttcttcaacaacaaaacacacaacgcccgtatcgagttgcgccaccaacccataggccgtctgaaaggcagctggggcgtgcaatatttgggacaaaaatccagcgcgctttccgccattcccgaaaccgtccaacaaccgatgttgattgacaacaatgtccgccattacagctttttcggtgtagaacaggcaaattgggacaacttcacgcttgaaggcggcgtacgcgtggaaaaacaaaaagcctccatccggtacgacaaagcattgattgatcgagaaaactactacaaccagcccctgcccgacctcggcgcgcaccgccaaaccgcccgctcgttcgcactttcgggcaactggtatttcacgccacaccacaaactcagcctgaccgcctcccatcaggaacgcctgccgtcaacgcaagaactgtacgcacacggcaagcacgtcgccaccaacacctttgaagtcggcaacaaacacctcaacaaagagcgttccaacaatatcgaactcgcgctgggctacgaaggcgaccgctggcaatacaatctggcagcctaccgcaaccgattcggcaactacatttacgcccaaaccttaaacgacggacgcggccccaaatccatcgaagacgacagcgaaatgaagctcgtgcgctacaaccaatccggtgccgacttctacggcgcggaaggcgaaatctacttcaaaccgacaccgcgctaccgcatcggtgtttccggcgactatgtacgaggccgtctgaaaaacctgccgtccctacccggcagggaagatccctacggcaaacgtcccttcatcgcacaagccgaccaaaacgccccccgcattccggctgcgcgcctcggcttccacctgaaaacctcgctaaccgaccgtatcgatgccaatttggactactaccgcgtgttcgcccaaaacaaactcgcccgctacgaaacgcgtacgcccggacaccatatgctcaacctcggtgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtaaacgtgaagttttaa

SEQ ID NO: 602 - protein, 758 aa, Neisseria gonorrhoeae
MAQITLKPIVLSILLINTPLLAQAHETEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGEAGLRLSSGNLEKLTSAGINIGLGKNFVLHTEGLYRKSGDYAVPRYRNLKRLPDSHADSQTGSIGLSWVGEKGFIGAAYSDRRDRYGLPAHSHEYDDCHADIIWQKSLINKRYLQLYPHLLTEEDIDYDNPGLSCGFHDGDGAHAHTHNGKPWIDLRNKRYELRAEWKQPFPGFEALRVHLNRNDYHHDEKAGDAVENFFNNKTHNARIELRHQPIGRLKGSWGVQYLGQKSSALSAIPETVQQPMLIDNNVRHYSFFGVEQANWDNFTLEGGVRVEKQKASIRYDKALIDRENYYNQPLPDLGAHRQTARSFALSGNWYFTPHHKLSLTASHQERLPSTQELYAHGKHVATNTFEVGNKHLNKERSNNIELALGYEGDRWQYNLAAYRNRFGNYIYAQTLNDGRGPKSIEDDSEMKLVRYNQSGADFYGAEGEIYFKPTPRYRIGVSGDYVRGRLKNLPSLPGREDPYGKRPFIAQADQNAPRIPAARLGFHLKTSLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 603 - DNA, 2277 bp, Neisseria meningitidis
atggcacaaactacactcaaacccattgttttatcaattcttttaatcaacacacccctcctcgcccaagcgcatgaaactgagcaatcggtggatttggaaacggtcagcgtcgtcggcaaaagccgtccgcgcgccacgtcggggctgttgcacacttcgaccgcctccgacaaaatcatctccggcgataccttgcgccaaaaagccgtcaacttgggcgacgctttagacggcgtaccgggcatccacgcttcgcaatacggcggcggcgcgtctgctcccgtcattcgcggtcaaacaggcaggcggattaaagtgttgaaccatcacggcgaaacaggcgatatggcggatttttcgcccgatcacgccattatggtagataccgccttgtcgcaacaggtcgaaatcctgcgcgggccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggttttatcggcgtagcgtacagcgaccgtcgcgaccaatatggtctgcctgcccacagccacgaatacgatgattgccacgccgacatcatctggcaaaagagcttgattaacaaacgctatttacagctttatccgcacctgttgaccgaagaagacatcgattacgacaatccgggcttgagctgcggcttccacgacgacgataatgcacacgcacacacccacagcggcagaccgtggatagacctgcgcaacaaacgctacgaactccgtgccgaatggaagcaaccgttccccggttttgaagccctgcgcgtacacctgaaccgcaacgactaccgccacgacgaaaaagcaggcgatgcagtcgaaaacttttttaacaaccaaacgcaaaacgcccgcatcgagttgcgccaccaacccataggtcgtctgaaaggcagctggggcgtgcaatatttacaacaaaaatccagtgctttatctgccatatccgaagcggttaaacaaccgatgctgcttgacaacaaagtgcaacattacagctttttcggtgtagaacaggcaaactgggacaacttcacgcttgaaggaggcgtacgcgtggaaaaacaaaaagcctccattcagtacgacaaagcattgattgatcgggaaaactactacaaccaccccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggtaactacatttacgcccaaaccttaaacgacggacgcggccccaaatccatcgaagacgacagcgaaatgaagctcgtgcgctacaaccaatccggcgccgacttctacggcgcggaaggcgaaatctacttcaaaccgacaccgcgctaccgcatcggcgtttccggcgactatgtacgaggccgtctgaaaaacctgccttccctacccggcagagaagatgcctacggcaaccgtcctttcatcgcacaggacgaccaaaatgccccccgtgttccggctgcgcgcctcggcttccacctgaaagcctcgctgaccgaccgtatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagctttctctctgatacgccgcaaatgggccgcagctttaccggcggcgtgaacgtgaagttttaa

SEQ ID NO: 604 - protein, 758 aa, Neisseria meningitidis
MAQTTLKPIVLSILLINTPLLAQAHETEQSVDLETVSVVGKSRPRATSGLLHTSTASDKIISGDTLRQKAVNLGDALDGVPGIHASQYGGGASAPVIRGQTGRRIKVLNHHGETGDMADFSPDHAIMVDTALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGVAYSDRRDQYGLPAHSHEYDDCHADIIWQKSLINKRYLQLYPHLLTEEDIDYDNPGLSCGFHDDDNAHAHTHSGRPWIDLRNKRYELRAEWKQPFPGFEALRVHLNRNDYRHDEKAGDAVENFFNNQTQNARIELRHQPIGRLKGSWGVQYLQQKSSALSAISEAVKQPMLLDNKVQHYSFFGVEQANWDNFTLEGGVRVEKQKASIQYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPFIAQDDQNAPRVPAARLGFHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 605 - DNA, 2277 bp, Neisseria meningitidis
atggcacaaactacactcaaacccattgttttatcaattcttttaatcaacacacccctcctctcccaagcgcatggaactgagcaatcagtgggcttggaaacggtcagcgtcgtcggcaaaagccgtccgcgcgccacttcggggctgctgcacacttctaccgcctccgacaaaatcatcagcggcgacaccttgcgacaaaaagccgtcaacttgggtgatgctttagacggcgtaccgggcattcatgcctcgcaatacggcggcggcgcatccgctcccgttattcgcggtcaaacaggcagacggattaaagtgttgaaccatcacggcgaaacgggcgacatggcggacttctctccagaccatgcaatcatggtggacagcgccttgtcgcaacaggtcgaaatcctgcgcggtccggttacgctcttgtacagctcgggcaatgtggcggggctggtcgatgttgccgatggcaaaatccccgaaaaaatgcctgaaaacggcgtatcgggcgaactcggattgcgtttgagcagcggcaatctggaaaaactcacgtccggcggcatcaatatcggtttgggcaaaaactttgtattgcacacggaagggctgtaccgcaaatcgggggattacgccgtaccgcgttaccgcaatctgaaacgcctgcccgacagccacgccgattcgcaaacgggcagcatcgggctgtcttgggttggcgaaaaaggctttatcggcgcagcatacagcgaccgtcgcgaccaatatggtctgcctgcccacagccacgaatacgatgattgccacgccgacatcatctggcaaaagagtttgattaacaaacgctatttgcagctttatccgcacctgttgaccgaagaagacatcgattacgacaatccgggcttgagctgcggctttcacgacgacgatgatgcacacgcccatgcccacaacggcaaaccttggatagacctgcgcaacaaacgctacgaactccgcgccgaatggaagcaaccgttccccggttttgaagccctgcgcgtacacctgaaccgcaacgactaccgccacgacgaaaaagcaggcgatgcagtagaaaacttttttaacaaccaaacgcaaaacgcccgtatcgagttgcgccaccaacccataggccgtctgaaaggcagctggggcgtgcaatatttgggacaaaaatccagtgctttatctgccacatccgaagcggtcaaacaaccgatgctgcttgacaataaagtgcaacattacagctttttcggtgtagaacaggcaaactgggacaacttcacgcttgaaggcggcgtacgcgtggaaaaacaaaaagcctccatccgctacgacaaagcattgattgatcgggaaaactactacaaccatcccctgcccgacctcggcgcgcaccgccaaaccgcccgctcattcgcactttcgggcaactggtatttcacgccacaacacaaactcagcctgaccgcctcccatcaggaacgcctgccgtcaacgcaagagctgtacgcacacggcaaacacgtcgccaccaacacctttgaagtcggcaacaaacacctcaacaaagagcgttccaacaatatcgaactcgcgctgggctacgaaggcgaccgctggcaatacaatctggcactctaccgcaaccgcttcggcaactacatttacgcccaaaccttaaacgacggacgcggccccaaatccatcgaagacgacagcgaaatgaagctcgtgcgctacaaccaatccggtgcggacttctacggcgcggaaggcgaaatctacttcaaaccgacaccgcgctaccgcatcggcgtttccggcgactatgtacgaggccgtctgaaaaacctgccttccctacccggcagggaagacgcctacggcaaccgcccactcattgcccaagccgaccaaaacgcccctcgcgttccggctgcgcgcctcggcgtccacctgaaagcctcgctgaccgaccgcatcgatgccaatttggactactaccgcgtgttcgcccaaaacaaactcgcccgctacgaaacgcgcacgcccggacaccatatgctcaacctcggcgcaaactaccgccgcaatacgcgctatggcgagtggaattggtacgtcaaagccgacaacctgctcaaccaatccgtttacgcccacagcagcttcctctctgatacgccgcaaatgggccgcagctttaccggcggcgtgaacgtgaagttttaa

SEQ ID NO: 606 - protein, 758 aa, Neisseria meningitidis
MAQTTLKPIVLSILLINTPLLSQAHGTEQSVGLETVSVVGKSRPRATSGLLHTSTASDKIISGDTLRQKAVNLGDALDGVPGIHASQYGGGASAPVIRGQTGRRIKVLNHHGETGDMADFSPDHAIMVDSALSQQVEILRGPVTLLYSSGNVAGLVDVADGKIPEKMPENGVSGELGLRLSSGNLEKLTSGGINIGLGKNFVLHTEGLYRKSGDYAVPRYRNLKRLPDSHADSQTGSIGLSWVGEKGFIGAAYSDRRDQYGLPAHSHEYDDCHADIIWQKSLINKRYLQLYPHLLTEEDIDYDNPGLSCGFHDDDDAHAHAHNGKPWIDLRNKRYELRAEWKQPFPGFEALRVHLNRNDYRHDEKAGDAVENFFNNQTQNARIELRHQPIGRLKGSWGVQYLGQKSSALSATSEAVKQPMLLDNKVQHYSFFGVEQANWDNFTLEGGVRVEKQKASIRYDKALIDRENYYNHPLPDLGAHRQTARSFALSGNWYFTPQHKLSLTASHQERLPSTQELYAHGKHVATNTFEVGNKHLNKERSNNIELALGYEGDRWQYNLALYRNRFGNYIYAQTLNDGRGPKSIEDDSEMKLVRYNQSGADFYGAEGEIYFKPTPRYRIGVSGDYVRGRLKNLPSLPGREDAYGNRPLIAQADQNAPRVPAARLGVHLKASLTDRIDANLDYYRVFAQNKLARYETRTPGHHMLNLGANYRRNTRYGEWNWYVKADNLLNQSVYAHSSFLSDTPQMGRSFTGGVNVKF

SEQ ID NO: 607 - DNA, 1110 bp, Neisseria gonorrhoeae
tactgcaaggcagacccctttcccgccgccctgctggccaatcagaaaatcaccgcccgccaatccgataaagacgtgcgccacatcgaaatcgatttgagcggttcggatttgcactacctcccgggcgacgcgctcggcgtttggtttgacaacgatccggcactggtcggggaaatcctagacctgctcggcatcaatccggcaacggaaatacaggcgggcggaaaaaccctgccggttgcctccgcactgttatcccatttcgaactcacgcaaaacacccccgcctttgtcaaaggctatgccacgttcgccgataatgacgaactcgaccgtattgctgccgacaacgccgttttgcaaggctttgtgcaaagcacgccgattgccggtgtgctgcaccgcttcccggcaaaactgacggcggaacaattcgccggcctgctgcgcccgcttgcgccgcgcctgtattcgatttcctcgtcgcaggcggaagcgggggacgaagtgcacctgaccgtcggcgcagtgcgtttcgaacacgaagggcgcgccagggcgggcggcgcatcgggtttctttgccgaccggctggaagaggacggcacggtgcgcgtgtttgcggaacgcaacgacggcttcaggctgcccgaagacagccgcaagccgattgtgatgatcggctccggtaccggcgtcgcaccgttccgcgccttcgtccaacaacgtgccgcagaaaatgcggaaggcagaaactggctgattttcggcaatccgcattttgccgccgacttcctctatcagaccgaatggcagcagtttgccaaagacggcttcctgcacagatatgacttcgcctggtcgcgcgatcaggaagaaaaaatctatgtgcaggacaaaatccgcgaacaggcggaaggactttggcaatggctgcaggaaggcgcgcatatctatgtgtgcggcgatgcggcaaaaatggcaaaagaagtggaagccgccttgctggatgtgattatcggggcagggcattcggacgaagacggcgcagaaggatatttggatatgctgcgcgaagaaaaacgctatcagcgtgatgtttattga

SEQ ID NO: 608 - protein, 369 aa, Neisseria gonorrhoeae
YCKADPFPAALLANQKITARQSDKDVRHIEIDLSGSDLHYLPGDALGVWFDNDPALVGEILDLLGINPATEIQAGGKTLPVASALLSHFELTQNTPAFVKGYATFADNDELDRIAADNAVLQGFVQSTPIAGVLHRFPAKLTAEQFAGLLRPLAPRLYSISSSQAEAGDEVHLTVGAVRFEHEGRARAGGASGFFADRLEEDGTVRVFAERNDGFRLPEDSRKPIVMIGSGTGVAPFRAFVQQRAAENAEGRNWLIFGNPHFAADFLYQTEWQQFAKDGFLHRYDFAWSRDQEEKIYVQDKIREQAEGLWQWLQEGAHIYVCGDAAKMAKEVEAALLDVIIGAGHSDEDGAEGYLDMLREEKRYQRDVY

SEQ ID NO: 609 - DNA, 1800 bp, Neisseria meningitidis
atgcagaacacaaatccgccattaccgcctctgccgcccgaaatcacgcagctcctgtcggggctggacgcggcacaatgggcgtggctgtccggctacgcttgggcaaaagcaggaaacggggcatctgcaggactgcccgcgcttcagacggcattgccggcggcagaacctttttccgtaaccgtcctttccgcctcgcaaaccggcaatgcgaaatccgttgccgacaaagcggcggacagcctggaagccgccggcatccaagtcagtcgcgccgaactgaaagactataaggcgaaaaacatcgccggcgaacgccgcctgctgctggttacctccacccaaggcgaaggcgaaccgccgaaagaagccgtcgtgctgcacaaactgctgaacggcaaaaaagccccgaaattggacaaactccaatttgccgtactgggtttgggcgacagttcctatccgaatttctgtcaggcaggtaaagatttcgaccggcgttttgaagaattgggcgcaaaacggctgctcgaacgcgttgatgcggatttggactttaccgcctccgcaaacgcctggacagataatatcgccgcactcttaaaagaagaagccgcaaaaaaccgggcaacgcccgcgccgcagacaacgccccccgccggccttcagacggcaccggatggcaggtactgcaaggcagccccctttcccgccgccctgctggccaatcagaaaatcaccgcccgccaatccgataaagacgtgcgccacatcgaaatcgatttgagcggttcggatttgcactacctcccgggcgacgcgctcggcgtttggtttgacaacgatccggcactggtcagggaaatcctagacctgctcggcatcgatccggcaacggaaatacaggcgggcggaaagatgatgccggttgcgcgcgcactttcatctcatttcgaactcacgcaaaacactccggctttcgtcaaaggctatgccgcgttcgcccattatgaagaactcgataaaatcattgccgataacgccgttttgcaggatttcgtgcaaaacacgcctattgtcgatgtgctgcaccgcttcccggcaagcctgacggcagaacaattcatccgtttactgcgtccgcttgcaccccgtttgtattcgatttcttcagcacaggcggaagtgggcgatgaagtgcatttaactgtcggcgtggttcgttttgaacacgaaggccgcgccagaacgggcggcgcatcgggtttccttgccgaccggctggaagaggacggcacggtgcgcgtgtttgtggaacgcaacgacggcttcaggctgcccgaagacagccgcaagccgattgtgatgatcggctcgggcaccggcgtcgcaccgttccgcgctttcgtccaacaacgtgccgcagaaaatgcggaaggcaaaaactggctgattttcggcaatccgcattttgcccgtgattttctctatcaaaccgaatggcagcagtttgccaaagacggcttcctgcacaggtacgatttcgcctggtcccgcgatcaggaagaaaaaatctatgtgcaggacaaaatccgcgaacaggcggaaggactttggcaatggctgcaggaaggcgcgcatatctatgtgtgcggcgatgcggcaaaaatggcaaaagacgtggaagccgccttgctggatgtgattatcggggcaggacatttggacgaagagggcgcagaagaatatttggatatgctgcgcgaagaaaaacgctatcagcgtgatgtttattga

SEQ ID NO: 610 - protein, 599 aa, Neisseria meningitidis
MQNTNPPLPPLPPEITQLLSGLDAAQWAWLSGYAWAKAGNGASAGLPALQTALPAAEPFSVTVLSASQTGNAKSVADKAADSLEAAGIQVSRAELKDYKAKNIAGERRLLLVTSTQGEGEPPKEAVVLHKLLNGKKAPKLDKLQFAVLGLGDSSYPNFCQAGKDFDRRFEELGAKRLLERVDADLDFTASANAWTDNIAALLKEEAAKNRATPAPQTTPPAGLQTAPDGRYCKAAPFPAALLANQKITARQSDKDVRHIEIDLSGSDLHYLPGDALGVWFDNDPALVREILDLLGIDPATEIQAGGKMMPVARALSSHFELTQNTPAFVKGYAAFAHYEELDKIIADNAVLQDFVQNTPIVDVLHRFPASLTAEQFIRLLRPLAPRLYSISSAQAEVGDEVHLTVGVVRFEHEGRARTGGASGFLADRLEEDGTVRVFVERNDGFRLPEDSRKPIVMIGSGTGVAPFRAFVQQRAAENAEGKNWLIFGNPHFARDFLYQTEWQQFAKDGFLHRYDFAWSRDQEEKIYVQDKIREQAEGLWQWLQEGAHIYVCGDAAKMAKDVEAALLDVIIGAGHLDEEGAEEYLDMLREEKRYQRDVY

SEQ ID NO: 611 - DNA, 1800 bp, Neisseria meningitidis
atgcagaacacaaatccgccattaccgcctatgccgcccgaaatcacgcagctcctgtcggggctggacgcggcacaatgggcgtggctgtccggctacgcttgggcaaaagcaggaaacggggcatctgcaggactgcccgcgcttcagacggcattgccgacggcagaacctttttccgtaaccgtcctttccgcctcgcaaaccggcaatgcgaaatccgttgccgacaaagcggcggacagcctggaagccgccggcatccaagtcagtcgcgccgaactgaaagactataaggcgaaaaacatcgccggcgaacgccgcctgctgctggttacctccacccaaggcgaaggcgaaccgccggaagaagccgtcgtgctgcacaaactgctgaacggcaaaaaagccccgaaattggacaaactccaatttgccgtactgggtttgggcgacagctcctatccgaatttctgccgggcgggcaaagatttcgacaaacgttttgaagaattgggcgcaaaacgcctgctcgaacgcgttgatgcggatttggactttgccgccgccgcagacggatggacagataatatcgccgcactcttaaaagaagaagccgcaaaaaaccgggcaacgcccgcgccgcagacaacgccccccgccggccttcagacggcaccggatggcaggtactgcaaggcagacccctttcccgccgccctgctggccaatcagaaaatcaccgcccgccaatccgataaagacgtgcgccacatcgaaatcgatttgagcggttcggatttgcactacctcccgggcgacgcgctcggcgtttggtttgacaacgatccggcactggtcagggaaatcctagacctgctcggcatcgatcaggcaacggaaatacaggcgggcggaaaaaccctgccggttgcctccgcactgttatcccattttgaactcacgcaaaacacccccgcctttgtcaaaggctatgccccgttcgccgatgatgacgaactcgaccgtattgctgccgacaacgccgttttgcaaggctttgtgcaaagcacgccgattgccgatgtgctgcaccgcttcccggcaaaactgacagcggaacaattcgccggcctactgcgcccgcttgcgccgcgcctgtattcgatttcctcgtcgcaggcggaagtgggggacgaagtgcacctgaccgtcggcgcggtgcgtttcgaacacgaagggcgcgccagggcgggcggcgcatcgggtttccttgccgaccggctggaagaggacggcacggtgcgcgtgtttgtggaacgcaacgacggcttcaggctgcccgaagacagccgcaagccgattgtgatgatcggctcgggcaccggcgtcgcaccgttccgcgctttcgtccaacaacgtgccgcagaaaatgcggaaggcaaaaactggctgtttttcggcaatccgcattttgcccgtgattttctctatcaaaccgaatggcagcagtttgccaaagacggcttcctgcacagatacgatttcgcctggtcgcgcgatcaggaagaaaaaatctatgtgcaggacaaaatccgcgaacaggcggaaggactttggcaatggctgcaggaaggcgcgcatatctatgtgtgcggcgatgcggcaaaaatggcaaaagacgtggaagccgccttgctggatgtgattatcggggcaggacatttggacgaagagggcgcagaagaatatttggatatgctgcgcgaagaaaaacgctatcagcgtgatgtttattga

SEQ ID NO: 612 - protein, 599 aa, Neisseria meningitidis
MQNTNPPLPPMPPEITQLLSGLDAAQWAWLSGYAWAKAGNGASAGLPALQTALPTAEPFSVTVLSASQTGNAKSVADKAADSLEAAGIQVSRAELKDYKAKNIAGERRLLLVTSTQGEGEPPEEAVVLHKLLNGKKAPKLDKLQFAVLGLGDSSYPNFCRAGKDFDKRFEELGAKRLLERVDADLDFAAAADGWTDNIAALLKEEAAKNRATPAPQTTPPAGLQTAPDGRYCKADPFPAALLANQKITARQSDKDVRHIEIDLSGSDLHYLPGDALGVWFDNDPALVREILDLLGIDQATEIQAGGKTLPVASALLSHFELTQNTPAFVKGYAPFADDDELDRIAADNAVLQGFVQSTPIADVLHRFPAKLTAEQFAGLLRPLAPRLYSISSSQAEVGDEVHLTVGAVRFEHEGRARAGGASGFLADRLEEDGTVRVFVERNDGFRLPEDSRKPIVMIGSGTGVAPFRAFVQQRAAENAEGKNWLFFGNPHFARDFLYQTEWQQFAKDGFLHRYDFAWSRDQEEKIYVQDKIREQAEGLWQWLQEGAHIYVCGDAAKMAKDVEAALLDVIIGAGHLDEEGAEEYLDMLREEKRYQRDVY

SEQ ID NO: 613 - DNA, 1812 bp, Neisseria gonorrhoeae
atgaaacaaatccgcaacatcgccatcatcgcacacgtcgaccacggcaaaaccacattggtcgaccaactgctgcgccaatccggcacattccgcgccaaccagcaggttgacgagcgcgtgatggacagcaacgaccttgaaaaagaacgcggcatcaccatcctcgccaaaaacaccgccatcgattacgaaggctgccacatcaatatcgtcgacacgccgggacacgccgacttcggcggcgaagtggagcgcgttttggggatggtggattgcgtcgtcttgttggtggacgcacaggaaggtccgatgccgcaaacccgtttcgtgaccaaaaaagccttggctttggggctgaaaccgattgtcgtcatcaacaaaatcgacaaaccgtccgcccgtccgagctgggttatcgaccagactttcgagttgttcgacaacttgggtgcgaccgacgagcagttggatttcccgattgtttacgcttcaggtttgagcggctttgccaagctggaagaaaccgacgagagcagcgatatgcgcccgctgttcgacaccatcctaaaatacacgcctgcaccgagcggcagcgcggacgagccgctgcaactgcaaatttcccaactcgactacgacaactacaccggccgcctcggtatcggtcgtatcttgaacggacgcatcaaacccggccaaaccgttgccgtgatgaaccacgagcagcaaatcgcccaaggccgcatcaaccagcttttgggtttcaaaggcttggaacgcgtgccgcttgaagaagccgaagccggcgacattgtgattatttccggtatcgaagacatcggcatcggcgtaaccatcaccgacaaagacaaccccaaaggcctgccgatgttgagcgtggacgaaccgacgctgacgatggactttatggtaaacaccagcccgctcgcaggtacagaaggcaaattcgtgaccagccgccaaatccgcgaccgcctgcaaaaagaattgctgaccaacgttgccctgcgcgtggaagacaccgccgatgccgacgtgttccgcgtatccgggcgcggcgaactgcacctgacgattttgctggaaaatatgcgccgcgaaggctacgaactcgccgtcggcaagccgcgcgtcgtgtaccgagacatcgacggtcaaaaatgcgaaccttatgaaaacctgactgtggacgtacccgacgacaaccaaggcgcggtaatggaagaactcggccgccgccgtggcgaactgaccaatatggaaagcgacggcaacggacgcacccgcctcgaataccatattccagcgcgcggcttgatcggtttccaaggcgaattcatgaccctgacgcgcggcgtcgggctgatgagccacgtgttcgacgactacgcgcccgtcaaacccgatatgcccggccgccacaacggcgtactggtgtcccaagagcagggcgaggcggttgcttacgccttgtggaatcttgaagaccgcggccgtatgttcgtatcgcccaacgacaaaatctacgaaggtatgattatcggcatccacagccgcgacaacgatttggtggtcaacccgctcaaaggcaaaaaactcaccaatatccgtgccagcggtaccgacgaagcggtgcgcctgaccacgccgatcaaactgacgctggaaggcgcggtcgagtttatcgacgatgacgagctggtggaaatcacgccgcaatccatccgcctgcgcatgcgttacctgagcgaattggaacgccgccgtcattttaaaaagctggattaa

SEQ ID NO: 614 - protein, 603 aa, Neisseria gonorrhoeae
MKQIRNIAIIAHVDHGKTTLVDQLLRQSGTFRANQQVDERVMDSNDLEKERGITILAKNTAIDYEGCHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESSDMRPLFDTILKYTPAPSGSADEPLQLQISQLDYDNYTGRLGIGRILNGRIKPGQTVAVMNHEQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRMRYLSELERRRHFKKLD

SEQ ID NO: 615 - DNA, 1812 bp, Neisseria meningitidis
atgaaacaaatccgcaacatcgccatcatcgcccacgtcgaccacggcaaaaccacattggtcgaccaactgctgcgccaatccggcacattccgcgccaaccagcaggttgacgagcgcgtgatggacagcaacgaccttgaaaaagaacgcggcatcaccatcctcgccaaaaacaccgccatcgattacgaaggctaccacatcaatatcgtcgacacgccgggacacgccgacttcggcggcgaagtagagcgcgttttggggatggtggactgcgtcgtcttgttggtggacgcgcaggaaggcccgatgccgcaaacccgtttcgtgaccaaaaaagccttggctttggggctgaaaccgattgtcgtcatcaacaaaatcgacaagccgtccgctcgtccgagctgggttatcgaccaaactttcgagctgttcgacaacttgggcgcgaccgacgagcagttggatttcccgattgtttacgcttcagggttgagcggtttcgccaaattggaagaaaccgacgagagcaacgacatgcgtccgctgttcgatactatcttaaaatatacgcctgcaccgagcggcagcgcggacgaaacgctgcaactgcaaatttcccaactcgactacgacaactacaccggccgcctcggtatcggtcgtatcttgaacggacgcatcaaacccggccaaaccgttgccgtcatgaaccacgatcagcaaatcgcccaaggccgcatcaaccagcttttgggtttcaaaggtttggaacgcgtgccgcttgaagaagccgaagccggcgacatcgtgattatttccggtatcgaagacatcggtatcggcgtaaccatcaccgacaaagacaatcccaaaggcctaccgatgttgagcgtggacgaaccgacgctgacgatggactttatggtcaacaccagcccgctggcgggtacggaaggcaaattcgtaaccagccgccaaatccgcgaccgcctgcaaaaagaattgctgaccaacgtcgccctgcgcgtggaagataccgccgatgccgacgtgttccgcgtatccgggcgcggcgagctgcacctgaccattttgctggaaaacatgcgccgcgaaggctacgaactcgccgtcggcaaaccgcgcgtcgtgtaccgcgacatcgacggtcaaaaatgcgaaccgtatgaaaacctgaccgtggatgtacccgacgacaaccaaggcgcggtaatggaagaactcggccgccgccgtggcgaactgactaatatggaaagcgacggcaacggacgcacccgcctcgaataccatattccagcgcgcggcttgatcggtttccaaggcgaatttatgaccctgacgcgcggggtcgggctgatgagccacgtgttcgacgattacgcgcccgtcaaacccgatatgcccggccgccacaacggcgtgctggtgtcccaagagcagggcgaggcagtcgcttacgccttgtggaatctggaagaccgcggccgtatgttcgtatcgcccaacgacaaaatctacgaaggcatgattatcggcatccacagtcgcgacaacgatttggtggtcaacccgctcaaaggcaaaaaacttaccaacatccgtgccagcggtaccgacgaagccgttcgcctgaccacgccaatcaagctgacgctggaaggtgcggttgagtttatcgacgatgacgaactcgttgaaatcacgccgcaatccatccgtctgcgcaagcgttacttgagcgaattggaacgccgccgccactttaaaaagctggattga

SEQ ID NO: 616 - protein, 603 aa, Neisseria meningitidis
MKQIRNIAIIAHVDHGKTTLVDQLLRQSGTFRANQQVDERVMDSNDLEKERGITILAKNTAIDYEGYHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESNDMRPLFDTILKYTPAPSGSADETLQLQISQLDYDNYTGRLGIGRILNGRIKPGQTVAVMNHDQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRKRYLSELERRRHFKKLD

SEQ ID NO: 617 - DNA, 1812 bp, Neisseria meningitidis
atgaaacaaatccgcaacatcgccatcatcgcccacgtcgaccacggcaaaaccacattggtcgaccaactgctgcgccaatccggcacattccgcgccaaccagcaggttgacgagcgcgtgatggacagcaacgaccttgaaaaagaacgcggcatcaccatcctcgccaaaaacaccgccatcgattacgaaggctaccacatcaatatcgtcgacacgccgggacacgccgacttcggcggcgaagtagagcgagttttggggatggtggactgcgtcgtcttgttggtggacgcgcaggaaggcccgatgccgcaaacccgtttcgtgaccaaaaaagccttggctttggggctgaaaccgattgtcgtcatcaataaaatcgacaaaccgtccgcccgtccgagctgggtcatcgaccaaactttcgagctgttcgacaacttgggcgcgaccgacgagcagttggatttcccgattgtttatgcttccggtctgtccggtttcgccaaattggaagaaaccgacgagagcaacgacatgcgtccgctgttcgatactatcttaaaatatacgcctgcaccgagcggcagcgcggacgaaacgctgcaactgcaaatttcccaactcgactacgacaactacaccggccgcctcggtatcggtcgtatcttgaacggacgtatcaagcccggtcaagttgttgccgtcatgaaccacgatcaacaaatcgcccaaggccgcatcaaccagcttttgggtttcaaaggtttagaacgcgtgccgcttgaagaagccgaagccggcgacatcgtgattatttccggtattgaagacatcggcatcggcgtaaccatcaccgacaaagacaaccccaaaggcctgccgatgttgagcgtggacgaaccgacgctgacgatggactttatggtcaacaccagcccgttggcaggtacggaaggcaaattcgtaaccagccgccaaatccgcgaccgcctgcaaaaagaattgctgaccaacgtcgccctgcgcgtggaagataccgccgatgccgacgtgttccgcgtatccgggcgcggcgagctgcacctgaccattttgctggaaaacatgcgccgcgaaggctacgaactcgccgtcggcaaaccgcgcgtcgtgtaccgcgacatcgacggtcaaaaatgcgaaccgtatgaaaacctgaccgtggacgtacccgacgacaaccaaggcgcggtaatggaagaactcggccgccgccgtggcgaactgactaatatggaaagcgacggcaacggacgcacccgcctcgaataccatattccagcgcgcggcttgatcggcttccaaggcgaatttatgaccctgacgcgcggggtcgggctgatgagccacgtgttcgacgattacgcgcccgtcaaacccgatatgcctggccgccacaacggcgtgctggtgtcccaagagcagggcgaggcagtcgcttacgccttgtggaatctggaagaccgcggccgtatgttcgtatcgcccaacgacaaaatctacgaaggtatgattatcggcatccacagtcgcgacaacgatttggtggtcaacccgctcaaaggcaaaaaacttaccaacatccgtgccagcggtaccgacgaagccgttcgcctgaccacgccgattaagctgacgctggaaggtgcggtcgagtttatcgacgatgatgagctggtagaaatcacgccgcaatccatccgtctgcgcaagcgttacttgagcgaattggaacgccgccgccatttcaaaaagctagattga

SEQ ID NO: 618 - protein, 603 aa, Neisseria meningitidis
MKQIRNIAIIAHVDHGKTTLVDQLLRQSGTFRANQQVDERVMDSNDLEKERGITILAKNTAIDYEGYHINIVDTPGHADFGGEVERVLGMVDCVVLLVDAQEGPMPQTRFVTKKALALGLKPIVVINKIDKPSARPSWVIDQTFELFDNLGATDEQLDFPIVYASGLSGFAKLEETDESNDMRPLFDTILKYTPAPSGSADETLQLQISQLDYDNYTGRLGIGRILNGRIKPGQVVAVMNHDQQIAQGRINQLLGFKGLERVPLEEAEAGDIVIISGIEDIGIGVTITDKDNPKGLPMLSVDEPTLTMDFMVNTSPLAGTEGKFVTSRQIRDRLQKELLTNVALRVEDTADADVFRVSGRGELHLTILLENMRREGYELAVGKPRVVYRDIDGQKCEPYENLTVDVPDDNQGAVMEELGRRRGELTNMESDGNGRTRLEYHIPARGLIGFQGEFMTLTRGVGLMSHVFDDYAPVKPDMPGRHNGVLVSQEQGEAVAYALWNLEDRGRMFVSPNDKIYEGMIIGIHSRDNDLVVNPLKGKKLTNIRASGTDEAVRLTTPIKLTLEGAVEFIDDDELVEITPQSIRLRKRYLSELERRRHFKKLD

SEQ ID NO: 619 - DNA, 657 bp, Neisseria gonorrhoeae
atgaaaaacaaaaccaaagtctgggacttccccacccgccttttccactggctgcttgccgcatccctgccctttatgtggtatagcgcaaaagccggcggcgatatgctgcaatggcacacgcgcgtcgggctgctcgtccttttcctgctcgtattccgcctctgctggggcatttggggcagcgataccgcccgtttctcccgtttcgtccgaggttgggcaggtatacgcggctatctgaaaaacggcattcccgaacatatccagcccggacacaaccccttgggcgcactgatggtcgttgcgcttttggccgccgtctcatttcaagtcggcacggggctttttgccgccaatgaaaacaccttcagcaccaacggctacctcaaccatttggtttccgaacatacgggcagccttatacggaaaatccacctcaactttttcaagctgctcgccgttttttccgcagtccacatcgccgccgtcgccgcataccgcatattcaaaaagaaaaacctcgtccgcccgatgataaccggcttcaaatacatcgaaggcaaaacctcaatccgctttgccggcaaagccgcgcttgccgccgcattatcggttgccgcgcttgccgcagccgccatcctgctcctgtcctga

SEQ ID NO: 620 - protein, 218 aa, Neisseria gonorrhoeae
MKNKTKVWDFPTRLFHWLLAASLPFMWYSAKAGGDMLQWHTRVGLLVLFLLVFRLCWGIWGSDTARFSRFVRGWAGIRGYLKNGIPEHIQPGHNPLGALMVVALLAAVSFQVGTGLFAANENTFSTNGYLNHLVSEHTGSLIRKIHLNFFKLLAVFSAVHIAAVAAYRIFKKKNLVRPMITGFKYIEGKTSIRFAGKAALAAALSVAALAAAAILLLS

SEQ ID NO: 621 - DNA, 657 bp, Neisseria meningitidis
atgaaaaacaaaaccaaagtctgggacctccccacccgccttttccactggctgcttgccgcgtccctgccctttatgtggtatagcgcgaaagccggcggcgatatgctgcaatggcacacgcgcgtcgggctgttcgtccttttcctgctcgtatttcgcctctgctggggcatttggggcagcgataccgcccgtttttcccgtttcgtccaaggctgggcaggcatacgcggctatctgaaaaacggtattcccgaacacatccagcccggacacaaccccttgggcgcactgatggtcgttgcgcttttggccgccgtgtccttccaagtcggcaccgggctttttgccgccgatgaaaacaccttcagcaccaacggctacctcaaccatttggtttccgaacatacgggcagccttatgcggaaaatccacctcaactttttcaagctgctcgccgttttttctgcaatccacatcgccgccgtcgccgcataccgcgtattcaaaaagaaaaacctcatcctcccgatgataaccggcttcaaatacatcgaaggcaaaacctcaatccgctttgcaggcaaagccgcgcttgccgccgcattatcggttgcctcgcttgccgcagccgccatcctgctcctgtcctga

SEQ ID NO: 622 - protein, 218 aa, Neisseria meningitidis
MKNKTKVWDLPTRLFHWLLAASLPFMWYSAKAGGDMLQWHTRVGLFVLFLLVFRLCWGIWGSDTARFSRFVQGWAGIRGYLKNGIPEHIQPGHNPLGALMVVALLAAVSFQVGTGLFAADENTFSTNGYLNHLVSEHTGSLMRKIHLNFFKLLAVFSAIHIAAVAAYRVFKKKNLILPMITGFKYIEGKTSIRFAGKAALAAALSVASLAAAAILLLS

SEQ ID NO: 623 - DNA, 657 bp, Neisseria meningitidis
  misc_feature (488)..(488): n is a, c, g, or t
atgaaaaacaaaaccaaagtctgggacttccccacccgccttttccactggctgcttgccgcatccctaccctttatgtggtatagcgcgaaaaccggcggcgatatgctgcaatggcacacgcgcgtcgggctgtttatccttttcctgctcgtattccgcctctgctggggcatttggggcagcgataccgcccgtttctcccgtttcgtccgcggatggtcgggtatcagagagtatatgaaaaacggtattcccgaacacgtccaacccggacacaaccccttgggcgcactgatggtcgttgcgcttttggccgccgtgtcgttccaagtcggcacagggctttttgccgccgatgtaaacaccttcagcaccaacggctacctcaaccatttggtttccgaacatacgggcagccttatgcggaaaatccatctcaactttttcaaactgctcgccgttttttccgcagtccacatcgccgncgtcgccgcataccgcgtgttcaaaaagaaaaacctcgtcctcccgatgataaccggcttcaaatacatcgaaggcaaaacctcaatccgctttgccggcaaagccgcgcttgccgccgcattatcggttgccgcgcttgccgcagccgccatcctgctcctgtcctga

SEQ ID NO: 624 - protein, 218 aa, Neisseria meningitidis
  misc_feature (163)..(163): Xaa can be any naturally occurring amino acid
MKNKTKVWDFPTRLFHWLLAASLPFMWYSAKTGGDMLQWHTRVGLFILFLLVFRLCWGIWGSDTARFSRFVRGWSGIREYMKNGIPEHVQPGHNPLGALMVVALLAAVSFQVGTGLFAADVNTFSTNGYLNHLVSEHTGSLMRKIHLNFFKLLAVFSAVHIAXVAAYRVFKKKNLVLPMITGFKYIEGKTSIRFAGKAALAAALSVAALAAAAILLLS

SEQ ID NO: 625 - DNA, 1077 bp, Neisseria gonorrhoeae
atggggtttgcttacagtatgacgtatatcgaggtcgggataccggaggcggcatccgtcctttcgctgcccgagatgatgcgcctgatggtgtttcaggattatggttttttggccgaagtgatgtttgtgctgactttcggcgcgccggttctgtttctgctgctgtgcctgtatgtctatgccgcgctgatacggaaacaggcgtatcctgcgctgcgtttggcaacgcgtgtgatggtgcgcttgaggcaggcgatgatggtggatgtgttttttgtttccactctggtggcgtatatcaagctctcgtctgtggcaaaggttcgcttcgggccggcgttttatctgatgttcgcgctgtcggttatgctgattcggacttcggtatcggttccccagcattgggtgtatttccaaatcgggcggctgacggggaataatgcggttcagacggcatcggaaggcaaaacctgttgcagccgctgcctgtatttccgcgacagtgccgaatccccctgcggggtgtgcggcgcggaactgtacggcggacggccgaaaagtctgagtatttcgtcggcgtttctgacggcggcggttgttttgtatttccctgccaatatcctgccgattatgatttcgtccaatcctgccgccacggaggccaacaccatctttagcggcatcgcttatatgtgggacgagggcgacaggctgattgcggcggttattttcagcgcgagtattttggtgccggtgctgaagattgcggcaatgtcggttttgattgcggcggcacggttcgctttgccggcgggcgcaaagaaattgtcgcacctctaccgcatcaccgaagcggtcggccgctggtcgatgattgatatttttgtgattattattttgatgtgttcgttccacacttatgccgcgcgcgtcattccgggcagtgcggcagtctatttctgcctggtcgtgattttgacgatgctgtccgcctattatttcgacccgcgcctgctttgggacaaacgcgcttcagacggcattgctttcaacgaaacggaaaaatatgactga

SEQ ID NO: 626 - protein, 358 aa, Neisseria gonorrhoeae
MGFAYSMTYIEVGIPEAASVLSLPEMMRLMVFQDYGFLAEVMFVLTFGAPVLFLLLCLYVYAALIRKQAYPALRLATRVMVRLRQAMMVDVFFVSTLVAYIKLSSVAKVRFGPAFYLMFALSVMLIRTSVSVPQHWVYFQIGRLTGNNAVQTASEGKTCCSRCLYFRDSAESPCGVCGAELYGGRPKSLSISSAFLTAAVVLYFPANILPIMISSNPAATEANTIFSGIAYMWDEGDRLIAAVIFSASILVPVLKIAAMSVLIAAARFALPAGAKKLSHLYRITEAVGRWSMIDIFVIIILMCSFHTYAARVIPGSAAVYFCLVVILTMLSAYYFDPRLLWDKRASDGIAFNETEKYD

SEQ ID NO: 627 - DNA, 1077 bp, Neisseria meningitidis
atggcgtttgcttacggtatgacgtatatcgaggtcgggataccgggtgcggcatccgtcctttcgctgcccgagatgatgcgcctgatggtgtttcaggattatggttttttggccgaagtgatgtttgtgctgactttcggcgcgccggttctgtttctgctgctgtgcctgtatgtctatgccgcgctgatacggaaacaggcgtatcctgcgctgcgtttggcaacgcgtgtgatggtgcgcttgagacaggcgatgatggtggatgtgttttttgtttccactttggtggcgtatatcaagctctcgtctgtggcagaggttcgcttcgggccggcgttttatctgatgttcgcgctgtcagttatgctgattcggacttcggtatcggttccccagcattgggtgtattttcaaatcgggcggctgacgggggataatgcggttcagacggcatcggaaggtaaaacctgttgcagccgctgcctgtatttccgcgacagtgccgaatccccctgcggcgtgtgcggtgcggaactgtaccgccgacggccgaaaagtctgagtatttcgtcggcgtttctgacggcggcggttattttgtatttccctgccaatatcctgccgattatgatttcgtccaatcctgccgccacggaggtcaataccatccttaacggcatcgcttatatgtgggacgagggcgacaggctgattgcggcggttattttcagcgcgagtattttggtgccggtactgaagattgcggcaatgtcggttttgattgcgtccgcccgcttcgctttgccaacgggtgcaaagaaattgtcgcacctctaccgcatcaccgaagcggtcggccgctggtcgatgattgatatttttgtgattattattttgatgtgttcgttccacacttatgccgcgcgcgtcattccgggcagtgcggcagtctatttctgcctggtcgtgattctgacgatgctgtccgcctattatttcgacccgcgcctgctttgggacaaacgcgcttcagacggcattgctttcaatgaaacggaaaaacatgactga

SEQ ID NO: 628 - protein, 358 aa, Neisseria meningitidis
MAFAYGMTYIEVGIPGAASVLSLPEMMRLMVFQDYGFLAEVMFVLTFGAPVLFLLLCLYVYAALIRKQAYPALRLATRVMVRLRQAMMVDVFFVSTLVAYIKLSSVAEVRFGPAFYLMFALSVMLIRTSVSVPQHWVYFQIGRLTGDNAVQTASEGKTCCSRCLYFRDSAESPCGVCGAELYRRRPKSLSISSAFLTAAVILYFPANILPIMISSNPAATEVNTILNGIAYMWDEGDRLIAAVIFSASILVPVLKIAAMSVLIASARFALPTGAKKLSHLYRITEAVGRWSMIDIFVIIILMCSFHTYAARVIPGSAAVYFCLVVILTMLSAYYFDPRLLWDKRASDGIAFNETEKHD

SEQ ID NO: 629 - DNA, 1077 bp, Neisseria meningitidis
atggcgtttgcttacggtatgacgtatatcgaggtcgggataccgggtgcggcatccgtcctttcgctgcccgagatgatgcgcctgatggtgtttcaggattatggttttttggccgaagtgatgtttgtgctgaccttcggcgcgccggttctgtttctgctgctgtgcctgtatgtctatgccgcgctgatacggaaacaggcgtatcctgcgctgcgtttggcaacgcgtgtgatggtgcgcttgagacaggcgatgatggtggatgtgttttttgtttccactttggtggcgtatatcaagctctcgtctgtggcagaggttcgcttcggatcggcgttttatctgatgttcgcgctgtcggttatgctgattcggacttcggtatcggttccccagcattgggtgtattttcaaatcgggcggctgacgggggataatgcggttcagacggcatcggaaggtaaaacctgttgcagccgctgcctgtatttccgcgacagtgccgaatccccctgcggcgtgtgcggtgcggaactgtaccgccgacggccgaaaagtctgagtatttcgtcggcgtttctgacggcggcggttattttgtatttccctgccaatatcctgccgattatgatttcgtccaatcctgccgccacggaggtcaataccatccttaacggcatcgcttatatgtgggacgagggcgacaggctgattgcggcggttattttcagcgcgagtattttggtgccggtactgaagattgcggcaatgtcggttttgattgcgtccgcccgcttcgctttgccaacgggtgcaaagaaattgtcgcacctctaccgcatcaccgaagcggtcggccgctggtcgatgattgatatttttgtgattattattttgatgtgttcgttccacacttatgccgcgcgcgtcattccgggcagtgcggcagtctatttctgcctggtcgtgattctgacgatgctgtccgcctattatttcgacccgcgcctgctttgggacaaacgcgcttcagacggcattgctttcaatgaaacggaaaaacatgactga

SEQ ID NO: 630 - protein, 358 aa, Neisseria meningitidis
MAFAYGMTYIEVGIPGAASVLSLPEMMRLMVFQDYGFLAEVMFVLTFGAPVLFLLLCLYVYAALIRKQAYPALRLATRVMVRLRQAMMVDVFFVSTLVAYIKLSSVAEVRFGSAFYLMFALSVMLIRTSVSVPQHWVYFQIGRLTGDNAVQTASEGKTCCSRCLYFRDSAESPCGVCGAELYRRRPKSLSISSAFLTAAVILYFPANILPIMISSNPAATEVNTILNGIAYMWDEGDRLIAAVIFSASILVPVLKIAAMSVLIASARFALPTGAKKLSHLYRITEAVGRWSMIDIFVIIILMCSFHTYAARVIPGSAAVYFCLVVILTMLSAYYFDPRLLWDKRASDGIAFNETEKHD

SEQ ID NO: 631 - DNA, 1662 bp, Neisseria gonorrhoeae
atgactgacaacagccctcctccaaacggacacgctcaagcacgcgtccgcaaaaacaacaccttcctctccgccgtctggctggtcccgctgatcgcgctgattgccggcggctggctttgggttaaggaaatccgcaacagggggcctgtggttacgctcttgatggacagcgcggaaggcatcgaagtcaacaatacggtcattaaggtattgagcatcgatgtcggacgcgttacccgaatcaaactgcgcgacgaccaaaaaggcgtggaagttactgcccaactcaatgcggacgtatccggcctcatccgcagcgatacccagttttgggtggtcaagccgcgtatcgaccaaagcggcgtaaccggtttgggtacgctgctttcgggttcgtacatcgcttttacacccggcaaaagcggcgaggcaaaagacgtgttccaagtgcaggacattccgcccgttaccgccatcgggcaaagcgggctgcgcttgaatttgattggtaaaaacgaccgcatcctcaacgtcaacagccctgttttgtatgaaaactttatggtcgggcaaatcgaaagcgcgcatttcgacccgtccgaccaaagcgtgcattacaccatcttcatccaaagccccaacgacaaactgattcattccgccagccgtttttggctggaaagcggcatcaatatcgaaaccacaggcagcggcatcaaactcaattccgcccctctgcctgccctgctgtcaggcgcgatttcatttgattcgccgaaaaccaaaaacagtaaaaacgtcaaaagcgaggacagcttcacgctttacgacagccgcagcgaaatcgccaacctgcctgacgaccgctcgctgtactacaccgcgtttttcaaacaatccgtgcgcggactgaccgtcggttcgcctgtcgaatacaaagggctgaatgtcggcatggtttccgatgtcccttattttgaccgcaatgacagcctgcacctgtttgaaaacggctggattcccgtacgcatccgcatcgagccttcccgtttggaaatcaatgccgacgagcaaagcaaagagcattggaaacaacaattccagacggccttaaacaaaggcctgaccgccaccatctccagcaacaacctgctgaccggcggcaaaatgattgagttgaacgatcagccttccgcctcgcccaagctgcgaccgcataccgtttatgcaggcgataccgtcatcgccacacggggcggcggtttggatgacttgcaggtcaaattggcggatttgctggacaaattcaacaatctgccattggataaaaccgttgccgaattgaacggctcgctcgccgaactcaagtccgcactcaaatccgccaatgccgccctaagctccattgacaaactggtcggcaatccgcagacgcaaaacatcccgaacgaactgaaccaaactctgaaagagttgcgcataaccctgcaaggcgtatcgcctcaatcgcctatctacggagacgtacaaaatacgctgcaaagtttggacaaaaccttaaaagacgttcaacccgtcattaacactttgaaagaaaaacccaacgcactgattttcaacaacagcagcaaagaccctatcccgaaaggaagccgataa

SEQ ID NO: 632 - protein, 553 aa, Neisseria gonorrhoeae
MTDNSPPPNGHAQARVRKNNTFLSAVWLVPLIALIAGGWLWVKEIRNRGPVVTLLMDSAEGIEVNNTVIKVLSIDVGRVTRIKLRDDQKGVEVTAQLNADVSGLIRSDTQFWVVKPRIDQSGVTGLGTLLSGSYIAFTPGKSGEAKDVFQVQDIPPVTAIGQSGLRLNLIGKNDRILNVNSPVLYENFMVGQIESAHFDPSDQSVHYTIFIQSPNDKLIHSASRFWLESGINIETTGSGIKLNSAPLPALLSGAISFDSPKTKNSKNVKSEDSFTLYDSRSEIANLPDDRSLYYTAFFKQSVRGLTVGSPVEYKGLNVGMVSDVPYFDRNDSLHLFENGWIPVRIRIEPSRLEINADEQSKEHWKQQFQTALNKGLTATISSNNLLTGGKMIELNDQPSASPKLRPHTVYAGDTVIATRGGGLDDLQVKLADLLDKFNNLPLDKTVAELNGSLAELKSALKSANAALSSIDKLVGNPQTQNIPNELNQTLKELRITLQGVSPQSPIYGDVQNTLQSLDKTLKDVQPVINTLKEKPNALIFNNSSKDPIPKGSR

SEQ ID NO: 633 - DNA, 1662 bp, Neisseria meningitidis
atgactgacaacagccctcctccaaacggacacgcccaagcacgcgtccgcaaaaacaacaccttcctctctgccgtctggctggttccgctgatcgcgctgattgccggcggctggctttgggttaaggaaatccgcaacagggggcctgtggttacgctcttgatggacagcgcggaaggcattgaggtcaacaatacggtcatcaaagtattgagcatcgatgtcggacgcgttacccgaatcaaactgcgcgacgaccaaaaaggcgtggaagtaaccgcccaactcaatgcggacgtatccggcctcatccgcagcgatacccagttttgggtggtcaagccgcgtatcgaccaaagcggcgtaaccggtttgggtacgctgctttcgggttcgtacatcgcctttacacccggcaaaagcgacgaggcaaaagacgtgttccaagtgcaggacattccgcccgttaccgccatcgggcaaagcgggctgcgcttgaatttgattggtaaaaacgaccgcatcctcaacgtcaacagccctgttttgtatgaaaattttatggtcgggcaagtcgaaagcgcgcatttcgacccgtccgaccaaagcgtgcattacaccatcttcatccaaagccccaacgacaaactgattcattccgccagccgtttttggctggaaagcggcatcaatatcgaaaccacaggcagcggcatcaaactcaattccgcccctctgcctgccctgctgtcgggcgcgatttcatttgattcgccgaaaaccaaaaacagtaaaaacgtcaaaagcgaagacagcttcacgctttacgacagccgcagcgaagtcgccaacctgcctgacgaccgctcgctgtactacaccgcgtttttcaaacaatccgtgcgcggcctgaccgtcggttcgcccgtcgagtacaaagggctgaatgtcggcgtggtttccgacgttccttatttcgaccgcaacgacagcctgcacctgtttgaaaacggctggatacccgtacgcatccgcattgaaccttcccgtttggaaatcaatgccgacgaacaaagcaaagaacattggaaacaacaatttcagacggccttaaacaaaggcctgaccgccaccatctccagcaacaacctgctgaccggaagcaaaatgattgagttgaacgatcagccttccgcatcacctaagctgcgaccgcataccgtttatgcaggcgataccgttatcgcgacccagggcggcggtttggacgatttgcaggtcaaattggcggatttgctggacaagttcgacaaactgcctttagataagacggttgccgaattgaacggttcgcttgccgagctcaaatccacactcaaatctgccaatgccgccctaagctccatcgacaaactggtcggcaaaccgcagacacaaaacattccgaacgaactgaaccaaaccctgaaagagttgcgcacaaccctgcaaggcgtatcgccgcaatcgcctatctacggcgacgtacaaaatacgctgcaaagtttggacaaaactttaaaagacgttcaacccgtgattaatactttgaaagaaaaacccaacgcgctgattttcaacagcagcagcaaagaccctatcccgaaaggaagccgataa

SEQ ID NO: 634 - protein, 553 aa, Neisseria meningitidis
MTDNSPPPNGHAQARVRKNNTFLSAVWLVPLIALIAGGWLWVKEIRNRGPVVTLLMDSAEGIEVNNTVIKVLSIDVGRVTRIKLRDDQKGVEVTAQLNADVSGLIRSDTQFWVVKPRIDQSGVTGLGTLLSGSYIAFTPGKSDEAKDVFQVQDIPPVTAIGQSGLRLNLIGKNDRILNVNSPVLYENFMVGQVESAHFDPSDQSVHYTIFIQSPNDKLIHSASRFWLESGINIETTGSGIKLNSAPLPALLSGAISFDSPKTKNSKNVKSEDSFTLYDSRSEVANLPDDRSLYYTAFFKQSVRGLTVGSPVEYKGLNVGVVSDVPYFDRNDSLHLFENGWIPVRIRIEPSRLEINADEQSKEHWKQQFQTALNKGLTATISSNNLLTGSKMIELNDQPSASPKLRPHTVYAGDTVIATQGGGLDDLQVKLADLLDKFDKLPLDKTVAELNGSLAELKSTLKSANAALSSIDKLVGKPQTQNIPNELNQTLKELRTTLQGVSPQSPIYGDVQNTLQSLDKTLKDVQPVINTLKEKPNALIFNSSSKDPIPKGSR

SEQ ID NO: 635 - DNA, 1662 bp, Neisseria meningitidis
atgactgacaacagccctcctccaaacggacacgcccaagcacgcgtccgcaaaaacaacaccttcctctctgccgtctggctggttccgctgatcgcgctgattgccggcggctggctttgggttaaggaaatccgcaacagggggcctgtggttacgctcttgatggacagcgcggaaggcattgaggtcaacaatacggtcatcaaagtattgagcatcgatgtcggacgcgttacccgaatcaaactgcgcgacgaccaaaaaggcgtggaagtaaccgcccaactcaatgcggacgtatccggcctcatccgcagcgatacccagttttgggtggtcaagccgcgtatcgaccaaagcggcgtaaccggtttgggtacgctgctttcgggttcgtacatcgcctttacacccggcaaaagcgacgaggcaaaagacgtgttccaagtgcaggacattccgcccgttaccgccatcgggcaaagcgggctgcgcttgaatttgattggtaaaaacgaccgcatcctcaacgtcaacagccctgttttgtatgaaaactttatggtcgggcaagtcgaaagcgcgcatttcgacccgtccgaccaaagcgtgcattacaccatcttcatccaaagccccaacgacaaactgattcattccgccagccgtttctggctggaaagcggcatcaatatcgaaaccacaggcagcggcatcaaactcaattccgcccctctgcctgccctgctgtcgggcgcgatttcatttgattcgccgaaaaccaaaaacagtaaaaacgtcaaaagcgaagacagcttcacgctttacgacagccgcagcgaagtcgccaacctgcctgatgaccgttcgctgtactacaccgcgtttttcaaacaatccgtgcgcggactgaccgtcggttcgcctgtcgagtacaaagggctgaatgtcggcgtggtttccgatgttccttatttcgaccgcaacgacagcctgcacctgtttgaaaacggctggattcccgtacgcatccgtattgagccttcccgtttggaaatcaatgccgacgaacaaagcaaagaacattggaaacaacaatttcagacggccttaaacaaaggcctgaccgccaccatctccagcaacaacctgctgaccggcagcaaaatgattgagttgaacgatcagccttccgcctcgcccaagctgcgaccgcataccgtttatgcaggcgataccgttatcgcgacccagggcggcggtttggacgatttgcaggtcaaattggcggatttgctggacaagttcgacaaactgcctttagataagacggttgccgaattgaacggttcgcttgccgagctcaaatccacactcaaatctgccaatgccgccctaagctccatcgacaaactggtcggcaaaccgcagacacaaaacattccgaacgaactgaaccaaaccctgaaagagttgcgcacaaccctgcaaggcgtatcgcctcaatcgcctatctacggcgacgtacaaaatacgctgcaaagtttggacaaaaccttaaaagacgttcaacccgtcattaacactttgaaagaaaaacccaacgcgctgattttcaacagcagcagcaaagaccctatcccgaaaggaagccgataa

SEQ ID NO: 636 - protein, 553 aa, Neisseria meningitidis; identical to SEQ ID NO: 634

SEQ ID NO: 637 - DNA, 1539 bp, Neisseria gonorrhoeae
atgaaaatcggtatcccacgcgagtcattatccggcgaaacccgcgtagcctgcacgcccgccaccgttgccctgctgggcaaactaggctttgaaaccgttgtcgaaagcggtgcaggtttggcggcaagtttggacgatgccgcttaccaaacagcaggcgcaaccgttgccgacaaagcggcggtttgggcctgccctttaatttataaggtcaacgcgccgtccgaaggcgagctgccgctgctcaaagaaggtcaaaccatcgtcagcttcctgtggccgcgccaaaacgaggctttggtcgaggccttgcgcgccaagaaagtcaacgcgctggcgatggacatggttccccgcatttcccgcgctcaggccttggacgctttgtcttcaatggcaaacatcagcggctaccgcgccgtgattgaagccgccaacgccttcggccgtttcttcaccggtcaaatcactgccgccggcaaagtgccgcctgcgcaggttttggtgattggcgccggtgtggcgggtttggcggcaatcggtacggcaaattcgctcggcgcagtggtgcgcgcgttcgatacccgcttggaagtggcggaacaaatcgaatcgatgggcggtaagttcctgaaactcgacttcctgcaagaatcgggcggcagcggagacggctacgccaaagtgatgagcgacgaatttatcgccgccgaaatgaagctctttgccgaacaggcgaaagaagtggacatcatcatcaccaccgccgccattccgggcaaacccgctcccaagctgattaccaaagaaatggtggaaagcatgaaatccggatccgtcatcgtcgatttggcggcgacgggcggcaactgcgaactcacccgaccgggcgaattgtccgtaaccggcaacggcgtgaaaatcatcggctacaccgacatggcaaaccgccttgccggacagtcttcccagctttacgccaccaacttggtgaacctgaccaagctgttaagcccgaacaaagacggcgaaatcacgctggacttcgaagacgtgattatccgcaatatgaccgttacccgcgacggcgaaatcaccttcccgcctccgccgattcaggtttccgcccggccgcagcaaacgccgtctgaaaaagccgcgcctgccgccaagcccgagccgaaacctgttcccctgtggaaaaaactcgcgcccgccgccatcgccgccgtattggtgctgtgggtcggcgcggtcgcacccgcagcattcttgaaccactttatcgtcttcgtcctcgcctgcgtcatcggctaccatgtcgtttggaacgtcagccactcgctgcacacaccgctgatgtcggtaaccaacgccatctccggcatcatggtcgtcggcgcgctgctgcaaatcggtcagggcaacggcttcgtttcgctgctgtcgtttgttgccatcctgattgccggcatcaatatcttcggcggctttgcggttacacggcgtatgctgaatatgtttaagaaagggtaa

SEQ ID NO: 638 - protein, 512 aa, Neisseria gonorrhoeae
MKIGIPRESLSGETRVACTPATVALLGKLGFETVVESGAGLAASLDDAAYQTAGATVADKAAVWACPLIYKVNAPSEGELPLLKEGQTIVSFLWPRQNEALVEALRAKKVNALAMDMVPRISRAQALDALSSMANISGYRAVIEAANAFGRFFTGQITAAGKVPPAQVLVIGAGVAGLAAIGTANSLGAVVRAFDTRLEVAEQIESMGGKFLKLDFLQESGGSGDGYAKVMSDEFIAAEMKLFAEQAKEVDIIITTAAIPGKPAPKLITKEMVESMKSGSVIVDLAATGGNCELTRPGELSVTGNGVKIIGYTDMANRLAGQSSQLYATNLVNLTKLLSPNKDGEITLDFEDVIIRNMTVTRDGEITFPPPPIQVSARPQQTPSEKAAPAAKPEPKPVPLWKKLAPAAIAAVLVLWVGAVAPAAFLNHFIVFVLACVIGYHVVWNVSHSLHTPLMSVTNAISGIMVVGALLQIGQGNGFVSLLSFVAILIAGINIFGGFAVTRRMLNMFKKG

SEQ ID NO: 639 - DNA, 1542 bp, Neisseria meningitidis
atgaaaatcggtatcccacgcgagtcattatccggcgaaacccgcgtcgcctgtacgcccgccaccgtcgccctgctgggcaaactgggctttgaaaccgttgtcgaaagcggtgcaggtttggcggcaagtttggacgatgccgcttaccaaacagcaggcgcaaccgttgccgacaaagcggcggtttgggtctgccctttgatttataaggtcaacgcgccgtccgaacaggaactgccgcttttgaacgaaggtcaaaccatcgtcagcttcctgtggccgcgccaaaacgaggctttggtcgaagccttgcgcgccaagaaagtgaacgcgctggcgatggatatggtgccccgcatttcgcgcgcgcaggctttggacgctttgtcttcgatggcaaacatcagcggctaccgcgccgtaattgaagccgccaacgccttcggccgtttcttcaccggtcaaattaccgccgccggcaaagtgccgcccgcgcaggttttggtgattggtgcaggtgtggcaggtttggcggcgatcggtacggcaaactcgctcggcgcagtggtacgcgcgttcgatacccgcttggaagtggcggaacaaatcgaatcgatgggcggcaagttcctgaaactcgacttcccacaagaatcgggcggcagcggagacggctacgccaaagtgatgagcgacgaatttatcgcagccgagatgaagctctttgccgagcaggcgaaagaagtggacatcatcatcaccaccgccgccattccgggcaaacccgcgcccaagctgattaccaaagaaatggtggaaagcatgaaatccggctccgtcatcgtcgatttggcggcggcgacgggcggcaactgcgaactcacccgcccgggcgaattgtccgtaaccggcaacggcgtgaaaatcatcggctacaccgacatggcaaaccgccttgccggacagtcttcccagctttacgccaccaacttggtcaacctgaccaagctgttaagcccgaacaaagacggcgaaatcacgttggacttcgaagacgtgattatccgcaacatgaccgttacccacgacggcgaaatcaccttcccgcctccgccgattcaagtttccgcccagccgcagcaaacgccgtctgaaaaagccgtgcctgccgccaagcccgagccaaaacccgttcccctgtggaaaaaactcgcgcccgccgtcatcgccgccgtcttggtactgtgggtcggcgcggtcgcacccgcagcattcctgaaccactttatcgtgttcgttctcgcctgcgtcatcggctactacgtcgtctggaacgtcagccactcgctgcacacaccgctgatgtcggtaaccaacgccatctccggcatcatcgtcgtcggcgcgctgctgcaaatcggtcagggcaacggcttcgtttcgctgctgtcgtttgttgccatcctgattgccggcatcaacatcttcggcggctttgcggtaacacggcgtatgctgaatatgtttaagaaagggtaa

SEQ ID NO: 640 - protein, 513 aa, Neisseria meningitidis
MKIGIPRESLSGETRVACTPATVALLGKLGFETVVESGAGLAASLDDAAYQTAGATVADKAAVWVCPLIYKVNAPSEQELPLLNEGQTIVSFLWPRQNEALVEALRAKKVNALAMDMVPRISRAQALDALSSMANISGYRAVIEAANAFGRFFTGQITAAGKVPPAQVLVIGAGVAGLAAIGTANSLGAVVRAFDTRLEVAEQIESMGGKFLKLDFPQESGGSGDGYAKVMSDEFIAAEMKLFAEQAKEVDIIITTAAIPGKPAPKLITKEMVESMKSGSVIVDLAAATGGNCELTRPGELSVTGNGVKIIGYTDMANRLAGQSSQLYATNLVNLTKLLSPNKDGEITLDFEDVIIRNMTVTHDGEITFPPPPIQVSAQPQQTPSEKAVPAAKPEPKPVPLWKKLAPAVIAAVLVLWVGAVAPAAFLNHFIVFVLACVIGYYVVWNVSHSLHTPLMSVTNAISGIIVVGALLQIGQGNGFVSLLSFVAILIAGINIFGGFAVTRRMLNMFKKG

SEQ ID NO: 641 - DNA, 1541 bp, Neisseria meningitidis
  misc_feature (386)..(386): n is a, c, g, or t
  misc_feature (395)..(395): n is a, c, g, or t
  misc_feature (456)..(456): n is a, c, g, or t
  misc_feature (799)..(801): n is a, c, g, or t
  misc_feature (803)..(803): n is a, c, g, or t
  misc_feature (805)..(805): n is a, c, g, or t
  misc_feature (1224)..(1224): n is a, c, g, or t
  misc_feature (1226)..(1226): n is a, c, g, or t
atgaaaatcggtatcccacgtgagtcattatccggcgaaacccgcgtcgcctgtacgcccgccaccgtcgccctgctgggcaaactgggctttgaaaccgttgtcgaaagcggcgcaggtttggcggcaagtttggacgatgccgcttaccaagcagcaggcgcaaccgttgccgacaaagcagcggtttgggcataccctttaatttataaggttaacgcgccgtccgaagacgagctgccgctgctcaaagaaggacagaccatcgtcagcttcctgtggccgcgccaaaacgaggctttggtcgaagccttgcgcgccaagaaagtgaacgcgctggcaatggacatggtgccccgcatttcgcgcgcgcaggctttggacgntttgtcttngatggcaaacatcagcggctaccgcgccgtgattgaagccgccaacgccttcggccgtttnttcaccggccaaattactgccgcaggcaaagtgccgcccgcgcaggttttggtgattggtgcaggtgtggcaggtttggcggcgatcggtacggcaaactcgctcggcgcagtggtacgcgtgttcgatacccgcctgaagtggcggaacaattagaatcgatgggcggcaagttcctgaaactcgacttcccgcaagaatcgggcggcagcggcgacggctacgccaaagtgatgagcgacgaatttatcgccgccgagatgaagctttttgccgagcaggcgaaagaagtggacatcatcatcaccaccgccgccattccgggcaaacccgcgcccaagcnnntnancaaagaaatggtcgaaagcatgaaacccggctccgtcatcgtcgatttggcggcggcgacgggcggcaactgcgaactcaccaaacagggcgaattgttcgtaaccggcaacggcgtgaaaatcatcggctacaccgacatggcaaaccgccttgccggacagtcttcgcagctttacgccaccaacttggtcaacctgaccaagctgttaagcccgaacaaagacggcgaaatcacgctggacttcgaagacgtgattatccgcaacatgaccgttacccgcgacggcgaaatcaccttcccgcctccgccgattcaagtttccgcccaaccgcagcaaacgccgtctgaaaaagccgcgcctgccgccaagcccgaaccgaaacccgttcccctgtggaaaaaactcgcgcccgccntnatcgccgccgtgttggtactgtgggtcggcgcggtcgcacccgcagcattcctgaaccactttatcgtcttcgtcctcgcctgcgtcatcggctactatgtcgtttggaacgtcagccactcgctgcacacaccgctgatgtcggtgaccaacgccatttccggcatcatcgtcgtcggcgcgctgctgcaaatcggtcagggcaacggcttcgtttcgctgctgtcgtttgttgccatcctgattgccagcatcaacatcttcggcggcttctttgtaacgcggcggatgctgaatatgtttaggaaagggtaa

SEQ ID NO: 642 - protein, 513 aa, Neisseria meningitidis
  misc_feature (129)..(129): Xaa can be any naturally occurring amino acid
  misc_feature (132)..(132): Xaa can be any naturally occurring amino acid
  misc_feature (152)..(152): Xaa can be any naturally occurring amino acid
  misc_feature (199)..(199): Xaa can be any naturally occurring amino acid
  misc_feature (267)..(269): Xaa can be any naturally occurring amino acid
  misc_feature (409)..(409): Xaa can be any naturally occurring amino acid
MKIGIPRESLSGETRVACTPATVALLGKLGFETVVESGAGLAASLDDAAYQAAGATVADKAAVWAYPLIYKVNAPSEDELPLLKEGQTIVSFLWPRQNEALVEALRAKKVNALAMDMVPRISRAQALDXLSXMANISGYRAVIEAANAFGRXFTGQITAAGKVPPAQVLVIGAGVAGLAAIGTANSLGAVVRVFDTRLXVAEQLESMGGKFLKLDFPQESGGSGDGYAKVMSDEFIAAEMKLFAEQAKEVDIIITTAAIPGKPAPKXXXKEMVESMKPGSVIVDLAAATGGNCELTKQGELFVTGNGVKIIGYTDMANRLAGQSSQLYATNLVNLTKLLSPNKDGEITLDFEDVIIRNMTVTRDGEITFPPPPIQVSAQPQQTPSEKAAPAAKPEPKPVPLWKKLAPAXIAAVLVLWVGAVAPAAFLNHFIVFVLACVIGYYVVWNVSHSLHTPLMSVTNAISGIIVVGALLQIGQGNGFVSLLSFVAILIASINIFGGFFVTRRMLNMFRKG

SEQ ID NO: 643 - DNA, 384 bp, Neisseria gonorrhoeae
atgactttcgcctattggtgcattctgattgcctgcctattgccgcttttttgtgcggcgtatgccaaaaaagcgggcggattccggtttaaagacaaccacaatcctcgcggttttctggcacatacgcaaggcgcagccgcccgtgcccacgccgcgcagcaaaacggttttgaagcctttgcaccgtttgccgccgccgttttgacggcacacgcaaccggcaatgccggacaagcaaccgtcaacacgcttgccggattgttcatcctgttccgcctcgcctttatctggtgctacatcgcagacaaagcagcattgcgctcgctgatgtgggcgggcggatttgcctgcaccgtcggactgtttgtcgcggctgcttga

SEQ ID NO: 644 - protein, 127 aa, Neisseria gonorrhoeae
MTFAYWCILIACLLPLFCAAYAKKAGGFRFKDNHNPRGFLAHTQGAAARAHAAQQNGFEAFAPFAAAVLTAHATGNAGQATVNTLAGLFILFRLAFIWCYIADKAALRSLMWAGGFACTVGLFVAAA

SEQ ID NO: 645 - DNA, 384 bp, Neisseria meningitidis
atgactttcgcctattggtgtattctgattgcctgcctattgccgcttttttgtgcggcgtatgccaaaaaagcgggcggattccggtttaaagacaaccacaatccgcgcggttttctagcgcacacgcaaggcgcagccgcccgtgcccacgccgcacagcaaaacggttttgaagcctttgcaccgtttgccgccgccgttttgacggcacacgcaaccggcaatgcggcgcaatcgaccatcaacacgcttgcctgcctgttcatcctgttccgcctcgcctttatctggtgctatatcgccgacaaagccgctatgcgctcactgatgtgggcaggcggatttgcctgcaccgtcgggctgtttgtcgcggctgcttga

SEQ ID NO: 646 - protein, 127 aa, Neisseria meningitidis
MTFAYWCILIACLLPLFCAAYAKKAGGFRFKDNHNPRGFLAHTQGAAARAHAAQQNGFEAFAPFAAAVLTAHATGNAAQSTINTLACLFILFRLAFIWCYIADKAAMRSLMWAGGFACTVGLFVAAA

SEQ ID NO: 647 - DNA, 384 bp, Neisseria meningitidis
atgactttcgcctattggtgtattctgattgcctacctattgccgcttttttgtgcggcgtatgccaaaaaagcgggcggattccggtttaaagacaaccacaatccgcgcgattttctggcgcgcacgcaaggcacagccgcccgtgcccacgccgcgcagcaaaacggttttgaagcctttgcaccgtttgcagccgccgttttgacggcacacgcaaccggcaatgccggacaagcaaccgtcaacacgcttgccggcctgttcatcctgttccgcctcgcctttatctggtgctacatcgcagacaaagcagcattacgctcgctgatgtgggtgggcggatttgtctgcaccgtcgggctgtttgtcgtggctgcttga

SEQ ID NO: 648 - protein, 127 aa, Neisseria meningitidis
MTFAYWCILIAYLLPLFCAAYAKKAGGFRFKDNHNPRDFLARTQGTAARAHAAQQNGFEAFAPFAAAVLTAHATGNAGQATVNTLAGLFILFRLAFIWCYIADKAALRSLMWVGGFVCTVGLFVVAA

SEQ ID NO: 649 - DNA, 582 bp, Neisseria gonorrhoeae
atgaggaacgaggaaaaacgcgccctgcgccgcgaattgcgcgggcggcgttcgcaaatggggcgagacgtgcgggcggcggcggcgataaaaatcaaccgcctgctcaaacgttatatcaagcgcggtcggaaaatcggcgtgtattggccgatgggcaaggaattgcgtttgggcggctttgtccgcgcggcgcaaaaacgcggcgcaaaactctatctgccttatatcgaaccgcacacgcggcggatgtggtttacgccgtatcctgaacgcggaatggaacgggaacgcaagcgcggtagggcgaagctgcatgtccctcagtttgcagggcgcaaaatccgcgtgcacggtttgtcggtattgctcgtcccgcttgtcggcatagaccgcgaaggctaccgtttggggcaggcaggcggctattacgatgcgacgctttcggcgatgaaataccgtttgcaggcgaaaaccgtgggcgtgggctttgcctgccagttggtggacaggctcccacgcgaggcgcacgacctgccgctggacggttttgtatcggaagcggggatattgtgtttttag

SEQ ID NO: 650 - protein, 193 aa, Neisseria gonorrhoeae
MRNEEKRALRRELRGRRSQMGRDVRAAAAIKINRLLKRYIKRGRKIGVYWPMGKELRLGGFVRAAQKRGAKLYLPYIEPHTRRMWFTPYPERGMERERKRGRAKLHVPQFAGRKIRVHGLSVLLVPLVGIDREGYRLGQAGGYYDATLSAMKYRLQAKTVGVGFACQLVDRLPREAHDLPLDGFVSEAGILCF

SEQ ID NO: 651 - DNA, 582 bp, Neisseria meningitidis
atgaggaacgaggaaaaacgcgccctgcgccgcgaattgcgcgggcggcgttcgcaaatggggcgggacgtgcgggcggcggcaacggtaaaaatcaaccacctgctcaaacgttatattaaaaaagggcggaaaatcggcgtgtattggccgatgggcaaggaattgcgtttggacggctttgtccgcgcggcgcaaaaacgcggtgcggaactctacctgccttatatcgaaccgcgttcgcggcggatgtggtttacgccgtatcctgccgatggagtaaaacaagaacgcaagcgcggtagggcgaagctgcatgtccctcagtttgcaggtcggaaaaagcgtgtgcatgatttgaacctcctgcttgtgccagtggtcggtatggacaggctgggctaccgcttgggacaggcaggcggctattacgatgcgacgctttcagcgatgaaataccgtttgcaggcaaaaaccgtgggcgtgggctttgcctgccagttggtggacaggctgccggtcgaggcgcacgaccggtctttggacggttttgtgtcggaggcggggatattgtgtttttag

SEQ ID NO: 652 - protein, 193 aa, Neisseria meningitidis
MRNEEKRALRRELRGRRSQMGRDVRAAATVKINHLLKRYIKKGRKIGVYWPMGKELRLDGFVRAAQKRGAELYLPYIEPRSRRMWFTPYPADGVKQERKRGRAKLHVPQFAGRKKRVHDLNLLLVPVVGMDRLGYRLGQAGGYYDATLSAMKYRLQAKTVGVGFACQLVDRLPVEAHDRSLDGFVSEAGILCF

SEQ ID NO: 653 - DNA, 582 bp, Neisseria meningitidis
atgaggaacgaggaaaaacacgccttgcgccgagagttgcgccgcgcccgcgcgcagatggggcatcaagggcggttggcggcggggcaaacgattaaccgcctgctcaaacgttatatcaagcgtggtcggaaaatcggcgtgtattggccgatgggcaaggaattgcgtttggacggctttgtccgcgcggcgcaaaaacgcggtgcaaaactttatctgccttatatcgaaccgcgttcgcggcggatgtggtttacgccgtatcctgaaagcggaatggaacgggagcgcatacggggcagggcgaagttgaacgtgccgcagtttgcagggcgcaaaatccgcgtgcacggtttgtcggtattgctcgtcccgcttgtcggcatagaccgcgagggctaccgcttaggacaggcaggcggctattacgatgcgacgcttgcggcgatgaaataccgtttgcaggcaaaaaccgtgggcgtgggctttgcctgccagtttgtggacaggctgccgcgcgaaccgcacgatctgctgctggacggttttgtgtcggaggcggggatattgtgcttttag

SEQ ID NO: 654 - protein, 193 aa, Neisseria meningitidis
MRNEEKHALRRELRRARAQMGHQGRLAAGQTINRLLKRYIKRGRKIGVYWPMGKELRLDGFVRAAQKRGAKLYLPYIEPRSRRMWFTPYPESGMERERIRGRAKLNVPQFAGRKIRVHGLSVLLVPLVGIDREGYRLGQAGGYYDATLAAMKYRLQAKTVGVGFACQFVDRLPREPHDLLLDGFVSEAGILCF

SEQ ID NO: 655 - DNA, 912 bp, Neisseria gonorrhoeae
atgaaaaccaattcagaagaactgaccgtatttgttcaagtggtggaaagcggcagcttcagccgtgcggcggagcagttggagatggcaaattctgccgtaagccgcatcgtcaaacggctggaggaaaagttgggcgtgaacctgctcaaccgcaccacgcggcaactcaatctgacggaagaaggcgcgcaatatttccgccgcgcgcagagaatcctgcaagaaatggcagcggcggaaaccgaaatgctggcagtgcacgaagtaccgcaaggcgtgttgcgcgtggattccgcgatgccgatggtgctgcatctgctggcgccgctggcagcaaaattcaacgaacgctatccgcatatccgactttcgctcgtttcttccgaaggctatatcaatctgattgaacgcaaagtcgatattgccttacgggccggagaattggacgattccgggctgcgtgcacgccatctgtttgacagccacttccgcgtagtcgccagtcctgaatatttagcaaaacacggcacgccacaatctgcagaagatcttgccaaccatcaatgtttaggcttcacagaacccggttctctaaatacatgggcggttttagatgcgcagggaaatccctataaaatttcaccgcactttaccgccagcagcggtgaaatcttacgctcgttgtgcctttcaagttgcggtattgcttgcttatcagattttttggttgacaacgacatcactgaaggaaagttaattcccctattcgccgaacaaacctccaataaaacacacccctttaatgctgtttattacagcgataaagccgtcaacctccgcttacgcgtatttttggattttttagtgaaggaactgggaaaaaatatgaatagaacgaataccaaataa

SEQ ID NO: 656 - protein, 303 aa, Neisseria gonorrhoeae
MKTNSEELTVFVQVVESGSFSRAAEQLEMANSAVSRIVKRLEEKLGVNLLNRTTRQLNLTEEGAQYFRRAQRILQEMAAAETEMLAVHEVPQGVLRVDSAMPMVLHLLAPLAAKFNERYPHIRLSLVSSEGYINLIERKVDIALRAGELDDSGLRARHLFDSHFRVVASPEYLAKHGTPQSAEDLANHQCLGFTEPGSLNTWAVLDAQGNPYKISPHFTASSGEILRSLCLSSCGIACLSDFLVDNDITEGKLIPLFAEQTSNKTHPFNAVYYSDKAVNLRLRVFLDFLVKELGKNMNRTNTK

SEQ ID NO: 657 - DNA, 900 bp, Neisseria meningitidis
atgaaaaccaattcagaagaactgaccgtatttgttcaagtggtggaaagcggcagcttcagccgtgcggcggagcagttggcgatggcaaattctgccgtaagccgcatcgtcaaacggctggaggaaaagttgggtgtgaacctgctcaaccgcaccacgcggcaactcagtctgacggaagaaggcgcgcaatatttccgccgcgcgcagagaatcctgcaagaaatggcagcggcggaaaccgaaatgctggcagtgcacgaaataccgcaaggcgtgttgagcgtggattccgcgatgccgatggtgctgcatctgctggcgccgctggcagcaaaattcaacgaacgctatccgcatatccgactttcgctcgtttcttccgaaggctatatcaatctgattgaacgcaaagtcgatattgccttacgggccggagaattggacgattccgggctgcgtgcacgccatctgtttgacagccgcttccgcgtaatcgccagtcctgaatacctggcaaaacacggcacgccgcaatctacagaagagcttgccggccaccaatgtttaggcttcaccgaacccggttctctaaatacatgggcggttttagatgcgcagggaaatccctataagatttcaccgcactttaccgccagcagcggtgaaatcttacgctcgttgtgcctttcaggttgcggtattgtttgcttatcagattttttggttgacaacgacatcgctgaaggaaagttaattcccctgctcgccgaacaaacctccgataaaacacacccctttaatgctgtttattacagcgataaagccgtcaatctccgcttacgcgtatttttggattttttagtggaggaactgggaaacaatctctgtggataa

SEQ ID NO: 658 - protein, 299 aa, Neisseria meningitidis
MKTNSEELTVFVQVVESGSFSRAAEQLAMANSAVSRIVKRLEEKLGVNLLNRTTRQLSLTEEGAQYFRRAQRILQEMAAAETEMLAVHEIPQGVLSVDSAMPMVLHLLAPLAAKFNERYPHIRLSLVSSEGYINLIERKVDIALRAGELDDSGLRARHLFDSRFRVIASPEYLAKHGTPQSTEELAGHQCLGFTEPGSLNTWAVLDAQGNPYKISPHFTASSGEILRSLCLSGCGIVCLSDFLVDNDIAEGKLIPLLAEQTSDKTHPFNAVYYSDKAVNLRLRVFLDFLVEELGNNLCG

SEQ ID NO: 659 - DNA, 900 bp, Neisseria meningitidis
atgaaaaccaattcagaagaactgaccgtatttgttcaagtggtggaaagcggcagcttcagccgtgcggcggagcagttggcgatggcaaattctgccgtaagccgcatcgtcaaacggctggaggaaaagttgggtgtgaacctgctcaaccgcaccacgcggcaactcagtctgacggaagaaggcgcgcaatatttccgccgcgcgcagagaatcctgcaagaaatggcagcggcggaaaccgaaatgctggcagtgcacgaaataccgcaaggcgtgttgcgcgtggattccgcgatgccgatggtgctgcatctgctggcgccgctggcagcaaaattcaacgaacgctatccgcatatccgactttcgctcgtttcttccgaaggctatatcaatctgattgaacgcaaagtcgatattgccttacgggccggagaattggacgattccgggctgcgtgcacgccatctgtttgacagccgcttccgcgtaatcgccagtcctgaatacctggcaaaacacggcacgccgcaatctacagaagagcttgccggccaccaatgtttaggcttcaccgaacccggttctctaaatacatgggcggttttagatgcgcagggaaatccctataagatttcaccgcactttaccgccagcagcggtgaaatcttacgctcgttgtgcctttcaggttgcggtattgcttgcttatcagattttttggttgacaacgacatcgctgaaggaaagttaattcccctgctcgccgaacaaacctccaataaaacgcacccctttaatgctgtttattacagcgataaagccgtcaacctccgcttacgcgtatttttggattttttagtggaggaactgggaaacaatctctgtggataa

SEQ ID NO: 660 - protein, 299 aa, Neisseria meningitidis
MKTNSEELTVFVQVVESGSFSRAAEQLAMANSAVSRIVKRLEEKLGVNLLNRTTRQLSLTEEGAQYFRRAQRILQEMAAAETEMLAVHEIPQGVLRVDSAMPMVLHLLAPLAAKFNERYPHIRLSLVSSEGYINLIERKVDIALRAGELDDSGLRARHLFDSRFRVIASPEYLAKHGTPQSTEELAGHQCLGFTEPGSLNTWAVLDAQGNPYKISPHFTASSGEILRSLCLSGCGIACLSDFLVDNDIAEGKLIPLLAEQTSNKTHPFNAVYYSDKAVNLRLRVFLDFLVEELGNNLCG

SEQ ID NO: 661 - DNA, 897 bp, Neisseria gonorrhoeae
atggacattctggacaaactggtcgatctcgcccaattgacgggcagtgcggatgtgcagtgccttttgggcggacaatggcatgaaaccttgcaacgcgaagggctggtacacattgttacggcgggcagcggttatctctgcatcgacggcgaaacttccccgcgtccggtcggcacgggcgatattgtatttttcccgcgcggcttgggtcatgtgttgagccacgacggaaaatacggagaaagtttacaaccggacatacgacaaaacggcacatttatggtcaaacagtgcggcaacgggctggatatgagcctgttttgcgcccgtttccgctacgacacccacgccgatttgatgaacgggctgccggaaaccgtttttctgaacattgcccatccaagtttgcagtatgtggtttcaatgctgcaactggaaagcgaaaaacctttgacggggacggtttccgtggtcaacgcattaccgtccgtcctgctggtgcttatcctgcgcgcctatctcgaacaggataaggatgtcgaactctcgggcgtattgaaaggttggcaggacaaacgtttgggacatttgatccaaaaggtgatagacaaaccggaagacgaatggaatattgacaaaatggttgccgccgccaatatgtcgcgcgcgcaactgatgcgccgcttcaaaagccaagtcggactcagcccgcacgcctttgtgaaccatatccgcctgcaaaaaggcgcattgctgctgaagaaaaccccggattcggttttggaggtcgcgctgtcggtgggctttcagtcggaaacgcatttcggcaaggcgttcaaacggcaatatcacgtttcgccggggcaataccggaaagaaggcgggcaaaaataa

SEQ ID NO: 662 - protein, 298 aa, Neisseria gonorrhoeae
MDILDKLVDLAQLTGSADVQCLLGGQWHETLQREGLVHIVTAGSGYLCIDGETSPRPVGTGDIVFFPRGLGHVLSHDGKYGESLQPDIRQNGTFMVKQCGNGLDMSLFCARFRYDTHADLMNGLPETVFLNIAHPSLQYVVSMLQLESEKPLTGTVSVVNALPSVLLVLILRAYLEQDKDVELSGVLKGWQDKRLGHLIQKVIDKPEDEWNIDKMVAAANMSRAQLMRRFKSQVGLSPHAFVNHIRLQKGALLLKKTPDSVLEVALSVGFQSETHFGKAFKRQYHVSPGQYRKEGGQK

SEQ ID NO: 663 - DNA, 906 bp, Neisseria meningitidis
atggacattctggacaaactggtcgatttcgcccaattgacgggcagtgtggatgtgcagtgccttttgggcggacaatggtcggtacggcatgaaaccttgcaacgcgaaggattggtacacattgttacatcgggcagcggctatctctgcatcgacggcgaaacttccccgcgtccggtcagtacaggggatattgtatttttcccgcgcggcttgggtcatgtgttgagccacgacggaaaatgcggagaaagtttacaaccggatatgcggcagcacggtgcgtttacggtcaagcagtgcggcaacggacaggatatgagcctgttttgcgcccgtttccgctacgacacccacgccgatttgatgaacgggctgcctgaaaccgtttttctgaacattgcccatccgagtttacagtatgtggtttcaatgctgcaactggaaagcaaaaaacctttgacggggacggtttccatggtcaacgcattgtcgtccgtcctgctggtgcttatcctgcgcgcctatctcgaacaggataaggatgtcgaactctcgggcgtattgaaaggttggcaggacaaacgtttgggacatttaatccaaaaggtgatagacaaaccggaagacgaatggaatgtcgacaaaatggtggcggctgccaatatgtcgcgcgcgcaactgatgcgccgtttcaaaagccgggtcggactcagcccgcacgcctttgtgaaccatatccgcctgcaaaaaggcgcgttgctgctgaaaaaaaacccggattcggttttgtcggtcgcactgtcggtaggctttcagtcggaaacgcacttcggcaaggcgttcaaacggcaatatcacgtttcgccgggtcaataccggaaagaaggcgggcaaaaataa

SEQ ID NO: 664 - protein, 301 aa, Neisseria meningitidis
MDILDKLVDFAQLTGSVDVQCLLGGQWSVRHETLQREGLVHIVTSGSGYLCIDGETSPRPVSTGDIVFFPRGLGHVLSHDGKCGESLQPDMRQHGAFTVKQCGNGQDMSLFCARFRYDTHADLMNGLPETVFLNIAHPSLQYVVSMLQLESKKPLTGTVSMVNALSSVLLVLILRAYLEQDKDVELSGVLKGWQDKRLGHLIQKVIDKPEDEWNVDKMVAAANMSRAQLMRRFKSRVGLSPHAFVNHIRLQKGALLLKKNPDSVLSVALSVGFQSETHFGKAFKRQYHVSPGQYRKEGGQK

SEQ ID NO: 665 - DNA, 906 bp, Neisseria meningitidis; identical to SEQ ID NO: 663

SEQ ID NO: 666 - protein, 301 aa, Neisseria meningitidis; identical to SEQ ID NO: 664

SEQ ID NO: 667 - DNA, 903 bp, Neisseria gonorrhoeae
atggataccgcaaaaaaagacattttaggatcgggctggatgctggtggcggcggcctgcttcaccgttatgaacgtattgattaaagaggcatcggcaaaatttgccctcggcagcggcgaattggtcttttggcgcatgctgttttcaaccgttacgctcggtgctgccgccgtattgcggcgcgacaccttccgcacgccccattggaaaaaccacttaaaccgcagtatggtcgggacgggggcgatgctgctgctgttttacgcggtaacgcatctgcctttgacaaccggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaccggcggcactcgccgggctggcgggcggcgcgatgtccggctgggcgtatttgaaagtgcgcgaactgtctttggcgggcgaacccggctggcgcgtcgtgttttacctttccgcaaccggcgtggcgatgtcgtcggtttgggcgacgctgaccggctggcacaccctgtcctttccatcggcagtttatctgtcgggcatcggcgtgtccgcgctgattgcccaactgtcgatgacgcgcgcctacaaagtcggcgacaaattcacggttgcctcgctttcctatatgaccgtcgtcttttccgccctgtctgccgcattttttctgggcgaagagcttttctggcaggaaatactcggtatgtgcatcattatcctcagcggcattttgagcagcatccgccccattgccttcaaacagcggctgcaagccctcttccgccaaagataa

SEQ ID NO: 668 - protein, 300 aa, Neisseria gonorrhoeae
MDTAKKDILGSGWMLVAAACFTVMNVLIKEASAKFALGSGELVFWRMLFSTVTLGAAAVLRRDTFRTPHWKNHLNRSMVGTGAMLLLFYAVTHLPLTTGVTLSYTSSIFLAVFSFLILKERISVYTQAVLLLGFAGVVLLLNPSFRSGQEPAALAGLAGGAMSGWAYLKVRELSLAGEPGWRVVFYLSATGVAMSSVWATLTGWHTLSFPSAVYLSGIGVSALIAQLSMTRAYKVGDKFTVASLSYMTVVFSALSAAFFLGEELFWQEILGMCIIILSGILSSIRPIAFKQRLQALFRQR

SEQ ID NO: 669 - DNA, 903 bp, Neisseria meningitidis
atggataccgcaaaaaaagacattttaggatcgggctggatgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacamcttccgcacgccccattggaaaaaccacttaaaccgcagtatggtcgggacgggggcgatgctgctgctgttttacgcggtaacgcatctgcctttggccactggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcgtcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctgggcgaagagcttttctggcaggaaatactcggtatgtgcatcatcatcctcagcggtattttgagcagcatccgccccactgccttcaaacagcggctgcaatccctgttccgccaaagataa

SEQ ID NO: 670 - protein, 300 aa, Neisseria meningitidis
  misc_feature (64)..(64): Xaa can be any naturally occurring amino acid
MDTAKKDILGSGWMLVAAACFTIMNVLIKEASAKFALGSGELVFWRMLFSTVALGAAAVLRRDXFRTPHWKNHLNRSMVGTGAMLLLFYAVTHLPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLGEELFWQEILGMCIIILSGILSSIRPTAFKQRLQSLFRQR

SEQ ID NO: 671 - DNA, 903 bp, Neisseria meningitidis
atggataccgcaaaaaaagacattttaggatcgggctggatgctggtggcggcggcctgctttaccattatgaacgtattgattaaagaggcatcggcaaaatttgccctcggcagcggcgaattggtcttttggcgcatgctgttttcaaccgttgcgctcggggctgccgccgtattgcgtcgggacaccttccgcacgccccattggaaaaaccacttaaaccgcagtatggtcgggacgggggcgatgctgctgctgttttacgcggtaacgcatctgcctttggccaccggcgttaccctgagttacacctcgtcgatttttttggcggtattttccttcctgattttgaaagaacggatttccgtttacacgcaggcggtgctgctccttggttttgccggcgtggtattgctgcttaatccctcgttccgcagcggtcaggaaacggcggcactcgccgggctggcgggcggcgcgatgtccggctgggcgtatttgaaagtgcgcgaactgtctttggcgggcgaacccggctggcgcgtcgtgttttacctttccgtgacaggtgtggcgatgtcatcggtttgggcgacgctgaccggctggcacaccctgtcctttccatcggcagtttatctgtcgtgcatcggcgtgtccgcgctgattgcccaactgtcgatgacgcgcgcctacaaagtcggcgacaaattcacggttgcctcgctttcctatatgaccgtcgttttttccgctctgtctgccgcattttttctggccgaagagcttttctggcaggaaatactcggtatgtgcatcatcatcctcagcggtattttgagcagcatccgccccactgccttcaaacagcggctgcaatccctgttccgccaaagataa

SEQ ID NO: 672 - protein, 300 aa, Neisseria meningitidis
MDTAKKDILGSGWMLVAAACFTIMNVLIKEASAKFALGSGELVFWRMLFSTVALGAAAVLRRDTFRTPHWKNHLNRSMVGTGAMLLLFYAVTHLPLATGVTLSYTSSIFLAVFSFLILKERISVYTQAVLLLGFAGVVLLLNPSFRSGQETAALAGLAGGAMSGWAYLKVRELSLAGEPGWRVVFYLSVTGVAMSSVWATLTGWHTLSFPSAVYLSCIGVSALIAQLSMTRAYKVGDKFTVASLSYMTVVFSALSAAFFLAEELFWQEILGMCIIILSGILSSIRPTAFKQRLQSLFRQR

SEQ ID NO: 673 - DNA, 1983 bp, Neisseria gonorrhoeae
atggttattttgacgactttgttttttgtgtgtgttttggtggtattggttttaaccgtgccggatcaggtgcagatgtggctcgaccgggcaaaagaagtcatttttaccgagttcagctggttttatgttttaacgttttccatttttctgggttttctgctgatactctcggtcagcggtttgggaaacatcaggctaggacgggatgaagatgtgccggaattcggcttcctgtcgtggctggcgatgctgtttgcggccgggatgggcgtgggcctgatgtttttcggcgtggcagagccgttgatgcattatttttcggacattacggtcggcgcgccggaacacaggcagcagcaggcattgctgcacacggtgttccattggggcgttcacgcctggtcggtgtacggtacgattgcattggctttggcttatttcggtttccgctacaaactgccgcttgccctgcgttcttgtttttaccccctgttgaaagaaaaaatttccggaaggttcggcgatgccattgatattatggcgttgcttgctacttttttcggcatcatcaccacattggggttcggggcttcgcaactgggcgccggattgcaggaaatgggctggattgccgaaaacagcttcggcgtgcaggtcttgattatcgccgccgtaatgtccctcgccgtcgtttcggcaatatccggcgtggggaagggcgtgaaggtgttgagcgagttgaacctgggccttgcgtttttgctgctgttttttgttttggcggcggaccccactgtttacctgttgtcggcattcggcgacaacatagggaactacctcggaaatctggtgcgcctcagtttgaaaacttatgcgtacgaacgggaacacaagccgtggtttgaatcttggacggtgctttattgggcgtggtggtgttcttgggcgccgtttgtgggtttgtttatcgcgcgcatttcaaaggggcgcaccatccgcgagtttgtcttcggggttttgctcatccccggcctgttcggcgttttgtggtttaccgtcttcggcaatacggcgatttggctgaatgacggggttgcggggggaatgctcgaaaagatgacctcctctccggaaacgctgctttttaaattctttaattacctccccctgcccgaactgacgagcatcgtcagcctgctggtcatttccctgttttttgtaacttctgccgactccgggatttatgtcctgaacaatattacctctcgggacaaaggcttgagcgcgccacggtggcaggcggttatgtggggcgtgctgatgtctgccgttgccgttttgctgatgcgctcgggcggactcggcaacctgcagtctatgaccctgattgtttccctgccgtttgccctgctgatgctgataatgtgtttcagcctgtggaaaggcttgagtgcggataagaaatattttgagacccgggtcaaccctaccagtgtattttggacgggcggcaagtggaaagaacggctggtgcggataatgagccagacgcaggagcaggatattttaaaattcctcaaacataccgcatcgcccgctatgcacgagttgcaacgggagctttcggaagaatacggcttgagcgtccgggtcgataagatgtttcatcaggacgagcccgcaatcgagttcgtcattcggaaagagacgatgcgcgattttatgtacgggattaagtctgtcgggcaggatgtatccgaccagttgattaacgacggcaagctgccgcatatccggcaccagacaacttacaaaccctacgcttattttttcgacgggcgcgtcgggtacgatgtgcagtatatgaacaaggacgagctgattgccgacattttgaaaaactacgaacgttatttgatgttgttggatgatgtcggtcaggaactgatggcgcacgagcaggtggaattggcagagtaa

SEQ ID NO: 674 - protein, 660 aa, Neisseria gonorrhoeae
MVILTTLFFVCVLVVLVLTVPDQVQMWLDRAKEVIFTEFSWFYVLTFSIFLGFLLILSVSGLGNIRLGRDEDVPEFGFLSWLAMLFAAGMGVGLMFFGVAEPLMHYFSDITVGAPEHRQQQALLHTVFHWGVHAWSVYGTIALALAYFGFRYKLPLALRSCFYPLLKEKISGRFGDAIDIMALLATFFGIITTLGFGASQLGAGLQEMGWIAENSFGVQVLIIAAVMSLAVVSAISGVGKGVKVLSELNLGLAFLLLFFVLAADPTVYLLSAFGDNIGNYLGNLVRLSLKTYAYEREHKPWFESWTVLYWAWWCSWAPFVGLFIARISKGRTIREFVFGVLLIPGLFGVLWFTVFGNTAIWLNDGVAGGMLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVRIMSQTQEQDILKFLKHTASPAMHELQRELSEEYGLSVRVDKMFHQDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 675 - DNA, 1983 bp, Neisseria meningitidis
atggttattttgacgactttgttttttgtgtgtgttttggtggtattggttttaaccgtgccggatcaggtgcagatgtggctcgatcgggcaaaagaagtcatttttaccgagttcagctggttttatgttttaacgttttccatttttctgggtttcctgctgatactctcggtcagcagtttgggaaacatcaggctcggacgggatgaagatgtgccggaattcggcttcctgtcgtggctggcgatgctgtttgcggccgggatgggcgtgggtctgatgtttttcggcgtggcagagccgttgatgcattatttttcggacattacggccggcacgccggaacacaggcagcagcaggcattgctgcacacggtgttccattggggcgttcacgcttggtcggtgtacggtacgattgcattggctttggcttatttcggtttccgctacaagctgccgcttgccctgcgttcttgtttttaccccctgttgaaagaaaaaatttccggaaggttcggcgatgccattgatattatggcgttgcttgctacttttttcggcatcatcaccacattggggttcggggcttcgcaactgggcgccggattgcaggaaatgggctggattgccgaaaacagcttcagcgtgcaggttttgattatcgccgccgtcatgtccctcgccgtcgtttcggcaatatccggcgtggggaagggcgtgaaggtgttgagcgagttgaacctgggccttgcgtttttgctgctgttttttgttttggcggcgggacccactgtttacctgttgtcggcattcggcgacaacatagggaactacctcggaaatctggtgcgcctcagttttaaaacttatgcgtacgaacgggaacacaagccgtggtttgaatcttggacggtgctttattgggcgtggtggtgttcttgggcgccgtttgtgggtttgtttatcgcgcgcatttcaaaggggcgcaccatccgcgagtttgtcttcggggttttgctcatccccggcctgttcggcgttttgtggtttaccgtcttcggcaatacggcgatttggctgaatgacggggttgcggggggaatgctcgaaaagatgacctcctctccggaaacgctgctttttaaattctttaattacctccccctgcccgaattgacgagcatcgtcagcctgctggtcatttctctgttttttgtaacttctgccgattccgggatttatgtcctgaacaatattacctctcgggacaaaggcttgagcgcgccacggtggcaggcggttatgtggggcgtgctgatgtctgccgttgccgttttgctgatgcgctcgggcggactcggcaacctgcagtctatgaccctgattgtttccctgccgtttgccctgctgatgctgataatgtgtttcagcctgtggaaaggcttgagtgcggataagaaatattttgagacccgggttaaccctaccagtgtattttggacgggcggcaagtggaaagaacggctggtgcagataatgagccagacgcaggagcaggatattttaaaattcctcaaacagactgcatcgcccgctatgcacgagttgcaacgggagctttcggaagaatacggcttgagcgtccgggtcgataaaatgtttcatcgggacgagcccgcaatcgagttcgtcattcggaaagagacgatgcgcgattttatgtacgggattaagtctgtcgggcaggatgtatccgaccagttgattaacgacggcaagctgccgcatatccggcatcagacaacttacaaaccctacgcttattttttcgacgggcgcgtcgggtacgatgtgcagtatatgaacaaggacgagctgattgccgacattttgaaaaactacgaacgttatttgatgttgttggatgatgtcggtcaggaactgatggcgcacgagcaggtggaattggcagagtaa

SEQ ID NO: 676 - protein, 660 aa, Neisseria meningitidis
MVILTTLFFVCVLVVLVLTVPDQVQMWLDRAKEVIFTEFSWFYVLTFSIFLGFLLILSVSSLGNIRLGRDEDVPEFGFLSWLAMLFAAGMGVGLMFFGVAEPLMHYFSDITAGTPEHRQQQALLHTVFHWGVHAWSVYGTIALALAYFGFRYKLPLALRSCFYPLLKEKISGRFGDAIDIMALLATFFGIITTLGFGASQLGAGLQEMGWIAENSFSVQVLIIAAVMSLAVVSAISGVGKGVKVLSELNLGLAFLLLFFVLAAGPTVYLLSAFGDNIGNYLGNLVRLSFKTYAYEREHKPWFESWTVLYWAWWCSWAPFVGLFIARISKGRTIREFVFGVLLIPGLFGVLWFTVFGNTAIWLNDGVAGGMLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVQIMSQTQEQDILKFLKQTASPAMHELQRELSEEYGLSVRVDKMFHRDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 677 - DNA, 1983 bp, Neisseria meningitidis
atggttattttgacgactttgttttttgtgtgtgttttggtggtattggttttaaccgtgccggatcaggtgcagatgtggctcgatcgggcaaaagaagtcatttttaccgagttcagctggttttatgttttaacgttttccatttttctgggtttcctgctgatactctcggtcagcagtttgggaaacatcaggctcggacgggatgaagatgtgccggaattcggcttcctgtcgtggctggcgatgctgtttgcggccgggatgggcgtgggtctgatgtttttcggcgtggcagagccgttgatgcattatttttcggacattacggccggcacgccggaacacaggcagcagcaggcattgctgcacacggtgttccattggggcgttcacgcttggtcggtgtacggtacgattgcattggctttggcttatttcggtttccgctacaagctgccgcttgccctgcgttcttgtttttaccccctgttgaaagaaaaaatttccggaaggttcggcgatgccattgatattatggcgttgcttgctacttttttcggcatcatcaccacattggggttcggggcttcgcaactgggcgccggattgcaggaaataggctggattgccgaaaacagcttcagcgtgcaggttttgattatcgccgccgtcatgtccctcgccgtcgtttcggcaatatccggcgtggggaagggtgtgaaggtgttgagcgagttgaacctgggtcttgcgtttttgctgctgttttttgttttggcggcgggtcccactgtttacctgttgtcggcattcggcgacaacatagggaactacctcggaaatctggtgcgcctcagttttaaaacttatgcgtacgaacgggaacacaagccgtggtttgaatcttggacggtgctttattgggcgtggtggtgttcttgggcgccgtttgtgggtttgtttatcgcgcgcatttcaaaggggcgcaccatccgcgagtttgtcttcggggttttgctcatccccggcctgttcggcgttttgtggtttaccgtcttcggcaatacggcgatttggctgaatgacggggttgcggggggagtgctcgaaaagatgacctcctctccggaaacgctgctttttaaattctttaattacctccccctgcccgaattgacgagcatcgtcagcctgctggtcatttctctgttttttgtaacttctgccgattccgggatttatgtcctgaacaatattacctctcgggacaaaggcttgagcgcgccacggtggcaggcggttatgtggggcgtgctgatgtctgccgttgccgttttgctgatgcgctcgggcggactcggcaacctgcagtctatgaccctgattgtttccctgccgtttgccctgctgatgctgataatgtgtttcagcctgtggaaaggattgagtgcggataagaaatattttgagacccgggttaaccctaccagtgtattttggacgggcggcaagtggaaagaacggctggtgcagataatgagccagacgcaggagcaggatattttaaaattcctcaaacataccgcatcgcccgctatgcacgagttacaacgggagctttcggaagaatacggcttgagcgtccgggtcgataagatgtttcatcaggacgagcccgcaatcgagttcgtcattcggaaagagacgatgcgcgattttatgtacgggattaagtctgtcgggcaggatgtatccgaccagttgattaacgacggcaagctgccgcatatccggcatcagacaacttacaaaccctacgcttattttttcgacgggcgcgtcgggtacgatgtgcagtatatgaacaaggacgagctgattgccgacattttgaaaaactacgaacgttatttgatgttgttggatgatgtcggtcaggaactgatggcgcacgagcaggtggaattggcagagtaa

SEQ ID NO: 678 - protein, 660 aa, Neisseria meningitidis
MVILTTLFFVCVLVVLVLTVPDQVQMWLDRAKEVIFTEFSWFYVLTFSIFLGFLLILSVSSLGNIRLGRDEDVPEFGFLSWLAMLFAAGMGVGLMFFGVAEPLMHYFSDITAGTPEHRQQQALLHTVFHWGVHAWSVYGTIALALAYFGFRYKLPLALRSCFYPLLKEKISGRFGDAIDIMALLATFFGIITTLGFGASQLGAGLQEIGWIAENSFSVQVLIIAAVMSLAVVSAISGVGKGVKVLSELNLGLAFLLLFFVLAAGPTVYLLSAFGDNIGNYLGNLVRLSFKTYAYEREHKPWFESWTVLYWAWWCSWAPFVGLFIARISKGRTIREFVFGVLLIPGLFGVLWFTVFGNTAIWLNDGVAGGVLEKMTSSPETLLFKFFNYLPLPELTSIVSLLVISLFFVTSADSGIYVLNNITSRDKGLSAPRWQAVMWGVLMSAVAVLLMRSGGLGNLQSMTLIVSLPFALLMLIMCFSLWKGLSADKKYFETRVNPTSVFWTGGKWKERLVQIMSQTQEQDILKFLKHTASPAMHELQRELSEEYGLSVRVDKMFHQDEPAIEFVIRKETMRDFMYGIKSVGQDVSDQLINDGKLPHIRHQTTYKPYAYFFDGRVGYDVQYMNKDELIADILKNYERYLMLLDDVGQELMAHEQVELAE

SEQ ID NO: 679 - DNA, 1299 bp, Neisseria gonorrhoeae
atgaacacatttttgaaaaacagcgaatacgcgtatatcctgaacgactgcaaggcgcgcttcctgttcgcctcggccggcctgtcaaaagaattggcgggcctgaaggcgcaaacgcccgtcgaaaaaatcatttggacggacaaaagccggccggccggcgaaacggcggaaggcgatgccttttttgaaaacgtgcgccgcttccccgaaaaacccgacttgggccgccaaccccggataaatgatttggcacacatcatctacacctccggcacgacggggcatcccaaaggcgcgctaatcagttacgccaacctgttcgccaacctgaacggcatcgaacgcatctttaaaatttccaaacgcgaccgctttatcgttttcctgccgatgttccacagcttcacgctgacggctatggtgctgctgccgatttatatggcgtgttcgattattttggtcaaatccgttttccccttttccaacgttttgaaacaggccctgctcaaacgcgcaaccgtgtttttgggcgtacccgcgatttacaccgcgatgagcaaggcaaaaatcccttggtatttcagatggttcaaccgcatccgcctgtttatcagcggcggcgcgcctttggcggaacaaaccatcctcgattttaaagccaagttcccccgcgccaaattgctggaaggctacggactgagcgaagcctcgcccgtcgtcgccgtcaatacgcccgaacggcaaaaagcccgcagcgtcggcatccccctgcccggtttggaagccaaagccgtcgatgaagaattggtcgaagtgccgcgcggcgaagtgggcgaactgatcgtcaggggcggttcggtgatgcggggctacctcaatatgcctgccgccaccgatgaaaccatcgtcaacggctggttgaaaacgggcgatttcgttaccatagacgaggacggctttatctttatcgtcgaccgcaaaaaagatttgattatttccaaaggtcaaaacgtctatccgcgcgagatcgaagaagaaatccacaaactcgatgccgtcgaagccgccgccgtcatcggcgtgaaagaccgttatgccgacgaggaaatcgtcgccttcgtccaattgaaggaaggtatggatttgggcgaggacgaaatccgccgccacctgcgtaccgtgctggcaaatttcaaaatccccaaacagatccactttaaagacgggctgccgcgcaacgctacgggcaaagtattgaaacgggtgctgaaggagcagtttgaaggaaacaaatga

SEQ ID NO: 680 - protein, 432 aa, Neisseria gonorrhoeae
MNTFLKNSEYAYILNDCKARFLFASAGLSKELAGLKAQTPVEKIIWTDKSRPAGETAEGDAFFENVRRFPEKPDLGRQPRINDLAHIIYTSGTTGHPKGALISYANLFANLNGIERIFKISKRDRFIVFLPMFHSFTLTAMVLLPIYMACSIILVKSVFPFSNVLKQALLKRATVFLGVPAIYTAMSKAKIPWYFRWFNRIRLFISGGAPLAEQTILDFKAKFPRAKLLEGYGLSEASPVVAVNTPERQKARSVGIPLPGLEAKAVDEELVEVPRGEVGELIVRGGSVMRGYLNMPAATDETIVNGWLKTGDFVTIDEDGFIFIVDRKKDLIISKGQNVYPREIEEEIHKLDAVEAAAVIGVKDRYADEEIVAFVQLKEGMDLGEDEIRRHLRTVLANFKIPKQIHFKDGLPRNATGKVLKRVLKEQFEGNK

SEQ ID NO: 681 - DNA, 1554 bp, Neisseria meningitidis
atgaaccggacttatgccaatttctacgaaatgctcgccgccgcctgccgcaaaaacggaaacggcacggcagtgttcgacggcaaggaaaaaaccgcctaccgcgcgctcaagcaggaggccgaagccgtcgcggcgtatctgcaaaatatcggcgtgaagttcggcgacacggtcgcgctggcggtttccaattccacagaatttattaccgcctatttcgccatctccgccatcggcgcggtcgccgtaccgatgaacacatttttgaaaaacagcgaatacgcgtatatcctgaacgactgcaaggcgcgcttcctgttcgcctcggccggcctgtcaaaagaattggcgggcttgaaggcgcaaacgcccgtcgaaaaaatcatttggacggacaaaagccgtccgaccggcgaaacggcggaaggcgatgccttttttgaagacgtgcgccgcttccccgaaaaacccgacttgggccgccaaccccggataaatgatttggcacacatcatctacacctccggcacgacggggcatcccaaaggcgcgctaatcagttacgccaacctgttcgccaacctgaacggcatcgaacgcatctttaaaatttccaagcgcgaccgctttatcgttttcctgccgatgttccacagcttcacgctgacggctatggtgctgctgccgatttatatggcgtgttcgattattttggtcaaatccgtttttccgttttccaacgttttgaaacagacactgctcaaacgcgcgaccgtgtttttgggcgtacccgcgatttacaccgcgatgagcaaggcgaaaatcccttggtatttcagatggttcaaccgcattcgcctgtttatcagcggcggcgcgcctttggcggaacaaaccatcctcgatttcaaagccaagttcccccgcgccaaattgctggaaggctacggactgagcgaagcctctcccgtcgtcgccgtcaatacgcccgagaggcaaaaagcccgcagcgtcggcatccccctgcccggtttggaagccaaagccgtcgatgaagaattggtcgaagtgccgcgcggcgaagtgggcgaactgatcgtcaggggcggttcggtgatgcggggctacctcaatatgcctgccgccaccgatgaaaccatcgtcaacggctggttgaaaacgggcgatttcgttaccatagacgaagacggctttatctttatcgtcgaccgcaaaaaagatttgattatttccaaaggtcaaaatgtctatccgcgcgagattgaagaagaaatctacaaactcgatgccgtcgaagccgccgccgtcatcggcgtgaaagaccgttatgccgacgaggaaatcgtcgccttcgtccaattgaaggaaggtatggatttgggcgagaacgaaatccgccgccacctgcgtaccgtgctggcaaatttcaaaatccccaaacaaatccactttaaagacgggctgccgcgcaacgctacgggcaaggtattgaaacgggtgttgaaggagcagtttgacggaaacaaatga

SEQ ID NO: 682 - protein, 517 aa, Neisseria meningitidis
MNRTYANFYEMLAAACRKNGNGTAVFDGKEKTAYRALKQEAEAVAAYLQNIGVKFGDTVALAVSNSTEFITAYFAISAIGAVAVPMNTFLKNSEYAYILNDCKARFLFASAGLSKELAGLKAQTPVEKIIWTDKSRPTGETAEGDAFFEDVRRFPEKPDLGRQPRINDLAHIIYTSGTTGHPKGALISYANLFANLNGIERIFKISKRDRFIVFLPMFHSFTLTAMVLLPIYMACSIILVKSVFPFSNVLKQTLLKRATVFLGVPAIYTAMSKAKIPWYFRWFNRIRLFISGGAPLAEQTILDFKAKFPRAKLLEGYGLSEASPVVAVNTPERQKARSVGIPLPGLEAKAVDEELVEVPRGEVGELIVRGGSVMRGYLNMPAATDETIVNGWLKTGDFVTIDEDGFIFIVDRKKDLIISKGQNVYPREIEEEIYKLDAVEAAAVIGVKDRYADEEIVAFVQLKEGMDLGENEIRRHLRTVLANFKIPKQIHFKDGLPRNATGKVLKRVLKEQFDGNK

SEQ ID NO: 683 - DNA, 1554 bp, Neisseria meningitidis
atgaaccggacttatgccaatttctacgaaatgctgaccgccgcctgccgcaaaaacggcaacggcacggcagtgttcgacggcaaggaaaaaaccgcctaccgcgcgctcaagcaggaagccgaagccgttgcggcgtatctgcaaaatatcggcgtgaagttcggcgacacggtcgcgctggcggtttccaattccacggaatttattaccgcctatttcgccgtatccgccatcggcgcggttgccgtaccgatgaacacatttttgaaaaacagcgaatacgcgtatatcctgaacgactgcaaggcgcgcttcctgttcgcctcggccggcctgtcaaaagaattggcgggcttgaaggcgcaaacgcccgtcgaaaaaatcatttggacgggccaaagccgtccggacggcgaaatggcggaaggcgatgccttttttgaagacgtgcgccgcttccccgaaaaacccgacttgggccgccaaccccggataaatgatttggcacacatcatctacacctccggcacgacggggcatcccaaaggtgcgctaatcagctacgccaacctgttcgccaacctgaacggcatcgaacgcatctttaaaatctccaagcgcgaccgctttatcgttttcctgccgatgttccacagcttcacgctgacggctatggtgctgctgccgatttatatggcgtgttcgattattttggtcaaatccgttttccccttttccaacgttttgaaacaggcactgctcaaacgcgcgaccgtgtttttgggcgtgcccgcgatttacaccgcgatgagcaagacgaaaatcccttggtatttcagatggttcaaccgcatccgcctgtttatcagcggcggagcacctttggcggaacaaaccatcctcgatttcaaagccaagttcccccgcgccaaattgctggaaggctacggactgagcgaagcctcgcccgtcgtcgccgtcaatacgcccgagaggcaaaaagcccgcagcgtcggcatccccctgcccggtttggaagtcaaagccgtcgatgaagaattggtcgaagtgccgcgcggcgaagtgggcgaactgatcgtcaggggcggttcggtgatgcggggctacctcaatatgcctgccgccaccgatgaaaccatcgtcaacggctggttgaaaacgggcgatttcgttaccatagacgaagacggctttatctttatcgtcgaccgcaaaaaagatttgattatttccaaaggtcaaaatgtctatccgcgcgaaatcgaagaagaaatctacaaactcgatgccgtcgaagccgccgccgtcatcggcgtgaaagaccgttatgccgacgaggaaatcgtcgccttcgtccaattgaaggaaggtatggatttgggcgagaacgaaatccgccgccacctgcgtaccgtgctggcaaatttcaaaatccccaaacaaatccactttaaagacgggctgccgcgcaacgctacgggcaaggtattgaaacgggtgttgaaggagcagtttgacggaaacaaatga

SEQ ID NO: 684 - protein, 517 aa, Neisseria meningitidis
MNRTYANFYEMLTAACRKNGNGTAVFDGKEKTAYRALKQEAEAVAAYLQNIGVKFGDTVALAVSNSTEFITAYFAVSAIGAVAVPMNTFLKNSEYAYILNDCKARFLFASAGLSKELAGLKAQTPVEKIIWTGQSRPDGEMAEGDAFFEDVRRFPEKPDLGRQPRINDLAHIIYTSGTTGHPKGALISYANLFANLNGIERIFKISKRDRFIVFLPMFHSFTLTAMVLLPIYMACSIILVKSVFPFSNVLKQALLKRATVFLGVPAIYTAMSKTKIPWYFRWFNRIRLFISGGAPLAEQTILDFKAKFPRAKLLEGYGLSEASPVVAVNTPERQKARSVGIPLPGLEVKAVDEELVEVPRGEVGELIVRGGSVMRGYLNMPAATDETIVNGWLKTGDFVTIDEDGFIFIVDRKKDLIISKGQNVYPREIEEEIYKLDAVEAAAVIGVKDRYADEEIVAFVQLKEGMDLGENEIRRHLRTVLANFKIPKQIHFKDGLPRNATGKVLKRVLKEQFDGNK

SEQ ID NO: 685 - DNA, 1092 bp, Neisseria gonorrhoeae
atggctgaagcgacagacgttgtcttggtgggcggcggcattatgagcgcgactttgggcgttttgctcaaagaactcgaaccgtcttgggaaatcaccctgattgaacgcttggaagatgtggcgttggaatcgtcaaacgcgtggaacaacgccggcacggggcattccgcgctgtgcgaattgaactatgcgccgctgggtgcggacggcgtcatcaatccggcgcgcgccctgaatattgccgaacagtttcatgtcagccgccagttttgggcgacgctggtcgcggaaggcaagttggaagacaattccttcatcaatgccgtgccgcatatgtctttggtgatgaacgaagaccactgccgttacctgcaaaaacgctatgatgtgtttaaaacgcagaaactttttgaaaatatggaattttccaccgatcggaacaaaatttccgattgggctccgctgattatgcgcggccgggacgaaaaccaacccgtcgccgccaactattccgccgaaggcacggatgtcgatttcggacggctgacgcgccagatggtgaaatatttgcagggcaagggcgtaaaaaccgagttcaaccgccacgtcgaagacatcaaacgcgaatccgacggcgcgtgggtgctcaaaaccgccgatacccgcaacccagactggcagctcaccctccgcacccgcttcctcttcctcggcgcgggcggcggcgcactgaccctgctgcaaaaatccggcatccccgaaggcaaaggctacggcggcttacccgtgtccggcctgttcttccgcaacagcaaccccgaaaccgccgaacaacacaacgccaaagtgtacgggcaggcttccgtcggcgcgccgccgatgtccgtcccgcacctcgacacacgcaacgtagacggcaaacgacaccttatgttcggtccttacgcaggtttccgttccaacttcctcaagcaaggctcgtttatggatttgccgctgtccatccatatggacaacctctatcctatgctgcgcgccggctgggcgaatatgccgctgaccaaatacctgctgggcgaattgcgttaa

SEQ ID NO: 686 - protein, 363 aa, Neisseria gonorrhoeae
MAEATDVVLVGGGIMSATLGVLLKELEPSWEITLIERLEDVALESSNAWNNAGTGHSALCELNYAPLGADGVINPARALNIAEQFHVSRQFWATLVAEGKLEDNSFINAVPHMSLVMNEDHCRYLQKRYDVFKTQKLFENMEFSTDRNKISDWAPLIMRGRDENQPVAANYSAEGTDVDFGRLTRQMVKYLQGKGVKTEFNRHVEDIKRESDGAWVLKTADTRNPDWQLTLRTRFLFLGAGGGALTLLQKSGIPEGKGYGGLPVSGLFFRNSNPETAEQHNAKVYGQASVGAPPMSVPHLDTRNVDGKRHLMFGPYAGFRSNFLKQGSFMDLPLSIHMDNLYPMLRAGWANMPLTKYLLGELR

SEQ ID NO: 687 - DNA, 1068 bp, Neisseria meningitidis
atggctgaagcgacagacgttgtcttggtgggcggcggcattatgagcgcgactttgggcgttttgctcaaagaactcgaaccgtcttgggaaatcaccctgattgaacgcttggaagatgtggcgttggaatcgtcaaacgcgtggaacaacgccggcacggggcattccgcgctgtgcgaattgaactatgcgccgttgggtgcaaatgggattatcgatccggcgcgcgccctcaatattgccgaacagtttcatgtcagccgccagttttgggcgacgctggtcgcggaaggcaagttggaagacaattccttcatcaatgccgtgccgcatatgtctttggtgatgaatgaagaccattgttcttatcttcaaaaacgttatgacgcgtttaaaacccaaaaactttttgaaaatatggaattttccaccgatcggaacaaaatttccgattgggctccgctgatgatgcgcggccgggacgaaaaccaacccgtcgccgccaactactccgccgaaggtacggatgtcgatttcggacggctgacgcgccaaatggtgaaatatttgcagggcaagggcgtaaaaaccgagttcaaccgccacgtcgaagacatcaaacgcgaatccgacggcgcgtgggtgctcaaaaccgccgatacccgcaaccccgacgggcagctcaccctccgtacccgcttcctcttcctcggcgcgggcggcggcgcgctgaccctgctgcaaaaatccggcatccccgaaggcaaaggctacggcggcttccccgtgtccggcctgttcttccgcaacagcaaccccgaaaccgccgaacaacacaacgccaaagtgtacgggcaggcttccgtcggcgcgccgccgatgtccgtcccgcacctcgacacacgcaacgtggacggcaaacgccaccttatgttcggcccttacgcaggcttccgttccaacttcctcaagcaaggctcgcttatggatttgccgctgtccatccatatggacaacctctatcctatgctgtgcgccggctgggcgaatatgccgctgaccaaa

SEQ ID NO: 688 - protein, 356 aa, Neisseria meningitidis
MAEATDVVLVGGGIMSATLGVLLKELEPSWEITLIERLEDVALESSNAWNNAGTGHSALCELNYAPLGANGIIDPARALNIAEQFHVSRQFWATLVAEGKLEDNSFINAVPHMSLVMNEDHCSYLQKRYDAFKTQKLFENMEFSTDRNKISDWAPLMMRGRDENQPVAANYSAEGTDVDFGRLTRQMVKYLQGKGVKTEFNRHVEDIKRESDGAWVLKTADTRNPDGQLTLRTRFLFLGAGGGALTLLQKSGIPEGKGYGGFPVSGLFFRNSNPETAEQHNAKVYGQASVGAPPMSVPHLDTRNVDGKRHLMFGPYAGFRSNFLKQGSLMDLPLSIHMDNLYPMLCAGWANMPLTK

SEQ ID NO: 689 - DNA, 1467 bp, Neisseria meningitidis
atggctgaagcgacagacgttgtcttggtgggcggcggcattatgagcgcgactttgggcgttttgctcaaagaactcgaaccgtcttgggaaatcaccctgattgaacgcttggaagatgtggcgttggaatcgtcaaacgcgtggaacaacgccggcacggggcattccgcgctgtgcgaattgaactatgcgccgttgggtgcaaatgggattatcgatccggcgcgcgccctcaatattgccgaacagtttcatgtcagccgccagttttgggcgacgttggtcgcggaaggcaagttggaagacaattccttcatcaatgccgtgccgcatatgtctttggtgatgaatgaagaccattgttcttatcttcaaaaacgttatgacgcgtttaaaacccaaaaactttttgaaaatatggaattttccaccgatcggaacaaaatttccgattgggctccgctgatgatgcgcggccgggacgaaaaccaacccgtcgccgccaactactccgccgaaggcacggatgtcgatttcggacggctgacgcgccaaatggtgaaatatttgcagggcaagggcgtaaaaaccgagttcaaccgccacgtcgaagacatcaaacgcgaatccgacggcgcgtgggtgctcaaaaccgccgatacccgcaaccccgacgggcagctcaccctccgtacccgcttcctcttcctcggcgcgggcggcggcgcgctgaccctgctgcaaaaatccggcatccccgaaggcaaaggctacggtggctttcccgtgtccggcctgttcttccgcaacagcaaccccgaaaccgccgaacaacacaacgccaaagtgtacgggcaggcttccgtcggcgcgccgccgatgtccgtcccgcacctcgacacacgcaacgtggacggcaaacgccaccttatgttcggcccttacgcaggcttccgttccaacttcctcaagcaaggctcacttatggatttgccgctgtccatccatatggacaacctctatcctatgctgcgcgccggctgggcgaatatgccgctgaccaaatacctgctgggcgaattgcgtaaaaccaaagaagaacgcttcgcctccctgctggaatactaccccgaggcaaaccccgacgactgggaactcatcaccgcagggcaacgcgttcaaatcattaaaaaagactccgaaaaaggcggcgtgttgcagtttggtacggagattgtcgcacacgccgacggctcgctcgccgcattgctgggcgcgtcgccgggcgcatcgaccgccgtgccgctgatgatccggctgatgcaccaatgcttccccgaacgcaccccgtcttgggaaggccgtctgaaagagctggtaccgggttacggcatcaagttgaacgaaaaccccgaaagggcggatgaaattatcgcctataccgcgaaagtgttggatatttaa

SEQ ID NO: 690 - protein, 488 aa, Neisseria meningitidis
MAEATDVVLVGGGIMSATLGVLLKELEPSWEITLIERLEDVALESSNAWNNAGTGHSALCELNYAPLGANGIIDPARALNIAEQFHVSRQFWATLVAEGKLEDNSFINAVPHMSLVMNEDHCSYLQKRYDAFKTQKLFENMEFSTDRNKISDWAPLMMRGRDENQPVAANYSAEGTDVDFGRLTRQMVKYLQGKGVKTEFNRHVEDIKRESDGAWVLKTADTRNPDGQLTLRTRFLFLGAGGGALTLLQKSGIPEGKGYGGFPVSGLFFRNSNPETAEQHNAKVYGQASVGAPPMSVPHLDTRNVDGKRHLMFGPYAGFRSNFLKQGSLMDLPLSIHMDNLYPMLRAGWANMPLTKYLLGELRKTKEERFASLLEYYPEANPDDWELITAGQRVQIIKKDSEKGGVLQFGTEIVAHADGSLAALLGASPGASTAVPLMIRLMHQCFPERTPSWEGRLKELVPGYGIKLNENPERADEIIAYTAKVLDI

SEQ ID NO: 691 - DNA, 1338 bp, Neisseria gonorrhoeae
  misc_feature (1169)..(1169): n is a, c, g, or t
  misc_feature (1187)..(1187): n is a, c, g, or t
  misc_feature (1280)..(1280): n is a, c, g, or t
atggctgaagcgacagacgttgtcttggtgggcggcggcattatgagcgcgactttgggcgttttgctcaaagaactcgaaccgtcttgggaaatcaccctgattgaacgcttggaagatgtggcgttggaatcgtcaaacgcgtggaacaacgccggcacggggcattccgcgctgtgcgaattgaactatgcgccgctgggtgcggacggcgtcatcaatccggcgcgcgccctgaatattgccgaacagtttcatgtcagccgccagttttgggcgacgctggtcgcggaaggcaagttggaagacaattccttcatcaatgccgtgccgcatatgtctttggtgatgaacgaagaccactgccgttacctgcaaaaacgctatgatgtgtttaaaacgcagaaactttttgaaaatatggaattttccaccgatcggaacaaaatttccgattgggctccgctgattatgcgcggccgggacgaaaaccaacccgtcgccgccaactattccgccgaaggcacggatgtcgatttcggacggctgacgcgccagatggtgaaatatttgcagggcaagggcgtaaaaaccgagttcaaccgccacgtcgaagacatcaaacgcgaatccgacggcgcgtgggtgctcaaaaccgccgatacccgcaacccagactggcagctcaccctccgcacccgcttcctcttcctcggcgcgggcggcggcgcactgaccctgctgcaaaaatccggcatccccgaaggcaaaggctacggcggcttacccgtgtccggcctgttcttccgcaacagcaaccccgaaaccgccgaacaacacaacgccaaagtgtacgggcaggcttccgtcggcgcgccgccgatgtccgtcccgcacctcgacacacgcaacgtagacggcaaacgacaccttatgttcggtccttacgcaggtttccgttccaacttcctcaagcaaggctcgtttatggatttgccgctgtccatccatatggacaacctctatcctatgctgcgcgccggctgggcgaatatgccgctgaccaaatacctgctgggcgaattgcgtaaaaccaaagaagaacgctttgcctccctgctggaatactacccgaggcagacccgacgactggtactcatcacgcaggncacgcgtcatatcattanatatgactcgaaactgcgcgtgctgcagttgtacgagattgtgccacgcgacgctcgctcgcgcattctggagcgtcgcggcgcatcacgctntgcgctgatatccgctgatgacactgctccgagcgcgcccgtcttggaaagtgtctga

SEQ ID NO: 692 - protein, 445 aa, Neisseria gonorrhoeae
  misc_feature (390)..(390): Xaa can be any naturally occurring amino acid
  misc_feature (396)..(396): Xaa can be any naturally occurring amino acid
  misc_feature (427)..(427): Xaa can be any naturally occurring amino acid
MAEATDVVLVGGGIMSATLGVLLKELEPSWEITLIERLEDVALESSNAWNNAGTGHSALCELNYAPLGADGVINPARALNIAEQFHVSRQFWATLVAEGKLEDNSFINAVPHMSLVMNEDHCRYLQKRYDVFKTQKLFENMEFSTDRNKISDWAPLIMRGRDENQPVAANYSAEGTDVDFGRLTRQMVKYLQGKGVKTEFNRHVEDIKRESDGAWVLKTADTRNPDWQLTLRTRFLFLGAGGGALTLLQKSGIPEGKGYGGLPVSGLFFRNSNPETAEQHNAKVYGQASVGAPPMSVPHLDTRNVDGKRHLMFGPYAGFRSNFLKQGSFMDLPLSIHMDNLYPMLRAGWANMPLTKYLLGELRKTKEERFASLLEYYPRQTRRLVLITQXTRHIIXYDSKLRVLQLYEIVPRDARSRILERRGASRXALISADDTAPSAPVLESV

SEQ ID NO: 693 - DNA, 1467 bp, Neisseria meningitidis
atggctgaagcgacagacgttgtcttggtgggcggcggcattatgagcgcgactttgggcgttttgctcaaagaactcgaaccgtcttgggaaatcaccctgattgaacgcttggaagatgtggcgttggaatcgtcaaacgcgtggaacaacgccggcacggggcattccgcgctgtgcgaattgaactatgcgccgttgggtgcaaatgggattatcgatccggcgcgcgccctcaatattgccgaacagtttcatgtcagccgccagttttgggcgacgctggtcgcggaaggcaagttggaagacaattccttcatcaatgccgtgccgcatatgtctttggtgatgaatgaagaccattgttcttatcttcaaaaacgttatgacgcgtttaaaacccaaaaactttttgaaaatatggaattttccaccgatcggaacaaaatttccgattgggctccgctgatgatgcgcggccgggacgaaaaccaacccgtcgccgccaactactccgccgaaggtacggatgtcgatttcggacggctgacgcgccaaatggtgaaatatttgcagggcaagggcgtaaaaaccgagttcaaccgccacgtcgaagacatcaaacgcgaatccgacggcgcgtgggtgctcaaaaccgccgatacccgcaaccccgacgggcagctcaccctccgtacccgcttcctcttcctcggcgcgggcggcggcgcgctgaccctgctgcaaaaatccggcatccccgaaggcaaaggctacggcggcttccccgtgtccggcctgttcttccgcaacagcaaccccgaaaccgccgaacaacacaacgccaaagtgtacgggcaggcttccgtcggcgcgccgccgatgtccgtcccgcacctcgacacacgcaacgtggacggcaaacgccaccttatgttcggcccttacgcaggcttccgttccaacttcctcaagcaaggctcgcttatggatttgccgctgtccatccatatggacaacctctatcctatgctgtgcgccggctgggcgaatatgccgctgaccaaatacctgctgggcgaattgcgtaaaaccaaagaagaacgcttcgcctccctgctggaatactaccccgaggcaaaccccgacgactgggaactcatcaccgcagggcaacgcgtccaaatcattaaaaaagactccgaaaaaggcggcgtgctccagtttggtacggagattgtcgcccacgccgacggctcactcgccgcattgctgggcgcgtcgccgggcgcatcgaccgctgtgccgctgatgatccggctgatgcaccaatgcttccccgagcgcgccccgtcttgggaagaccgtctgaaagagctggtaccgggttacggcatcaagttgaacgaaaaccctgaaagggcggatgaaattatcgcctataccgcgaaagtattggatatttaa

SEQ ID NO: 694 - protein, 488 aa, Neisseria meningitidis
MAEATDVVLVGGGIMSATLGVLLKELEPSWEITLIERLEDVALESSNAWNNAGTGHSALCELNYAPLGANGIIDPARALNIAEQFHVSRQFWATLVAEGKLEDNSFINAVPHMSLVMNEDHCSYLQKRYDAFKTQKLFENMEFSTDRNKISDWAPLMMRGRDENQPVAANYSAEGTDVDFGRLTRQMVKYLQGKGVKTEFNRHVEDIKRESDGAWVLKTADTRNPDGQLTLRTRFLFLGAGGGALTLLQKSGIPEGKGYGGFPVSGLFFRNSNPETAEQHNAKVYGQASVGAPPMSVPHLDTRNVDGKRHLMFGPYAGFRSNFLKQGSLMDLPLSIHMDNLYPMLCAGWANMPLTKYLLGELRKTKEERFASLLEYYPEANPDDWELITAGQRVQIIKKDSEKGGVLQFGTEIVAHADGSLAALLGASPGASTAVPLMIRLMHQCFPERAPSWEDRLKELVPGYGIKLNENPERADEIIAYTAKVLDI

SEQ ID NO: 695 - DNA, 1467 bp, Neisseria meningitidis; identical to SEQ ID NO: 689

SEQ ID NO: 696 - protein, 488 aa, Neisseria meningitidis; identical to SEQ ID NO: 690

SEQ ID NO: 697 - DNA, 753 bp, Neisseria gonorrhoeae
atggcggcggcggaaataaaacgccccctcgctgtcgatttccagcacatagcgtccgttctgcacggcggcatagccgcttttgcctgcctgatagggttgcagggcggaatgcgaaatcaggtaatcagtcagtttgccgccgtcttcggcgatattgcccaccagtttggcaaacaaggtatggcacacgccgttttccgcccagcccgaaggcgcgtcctttccgtcggtttccatacatttgccgacgacggcttccaagtcgttgggatgctttccggtcagccggacggcgttttgttccggcaagcctttaatcggataactgatttgttttttgccgtcgttggttttgccttcgctactttgtcccaaagccaaaccggcaatcgccgtattgtcgatgtatttgactttgaaaaccggtttcggcgcgctttgtgccgcattttgcggctgttccgccgtattttcggatttgccgcaggcggcaagcagcaggcagccgcccaacacggcaaaaggtattttcagcattccgcactcctgatggtttcaaaatgccgtctgaaatgccgtctgaaacgtggcaggcggaggttcggacggcattgggtttatttcaacgggcggatgccgaccgcatcgcgtactttatccaacaattcgcgcgcttctttgcgcgctttttgcgcgcctgcctgcaaaatctcttcgatttgcgaaggattagaggtcaatgcgttgtag

SEQ ID NO: 698 - protein, 250 aa, Neisseria gonorrhoeae
MAAAEIKRPLAVDFQHIASVLHGGIAAFACLIGLQGGMRNQVISQFAAVFGDIAHQFGKQGMAHAVFRPARRRVLSVGFHTFADDGFQVVGMLSGQPDGVLFRQAFNRITDLFFAVVGFAFATLSQSQTGNRRIVDVFDFENRFRRALCRILRLFRRIFGFAAGGKQQAAAQHGKRYFQHSALLMVSKCRLKCRLKRGRRRFGRHWVYFNGRMPTASRTLSNNSRASLRAFCAPACKISSICEGLEVNAL

SEQ ID NO: 699 - DNA, 739 bp, Neisseria meningitidis
atggcggcggcggaaataaaacgccccttcgctgtcgatttccagcacatagcgtccgttctgcacggcggcatagccgcttttgcctgcctgatagggttgcagggcggcatgcgaaactaggtaatccgtcagtttgccgccgtcttcggcgatattgcccaccagtttggcaaacaaggtatggcacacgccgttttctgcccaacctgccggactgtccttatcatcggtttccatacatttgccgctgacggcttccaagtcgccgggatgcttgccgatcagtcggataacattttgttccggcaagcctttaatcggataactgatttgttttttgccgtcgttggttttgccttcgctgctttgtcccaaatccaaaccggcaatcgccgtattgtcgatatatatgactttgaaaaccggtttcggcgcgctttgtaccgcgttttgcggctgtaccgccgtatttwcggatttgccgcacggcaargcagcaggcagccgcccaatacggcaaaarawgtwttcagcattccacaytcctgatggtttcaaaatgccgtctgaaacgcggcaggcggaggttcggacggcatcgggttcatttcaacgggcggatgccgaccgcatcggtactttgtccaataattcgcgtgcttctttacgcgctttcgccgcgcctgcctgcaaaatctcttcgatttgcgaagggtcggcggtcagctcgttgtag

SEQ ID NO: 700 - protein, 245 aa, Neisseria meningitidis
  misc_feature (158)..(158): Xaa can be any naturally occurring amino acid
  misc_feature (165)..(165): Xaa can be any naturally occurring amino acid
  misc_feature (175)..(177): Xaa can be any naturally occurring amino acid
  misc_feature (182)..(182): Xaa can be any naturally occurring amino acid
MAAAEIKRPFAVDFQHIASVLHGGIAAFACLIGLQGGMRNVIRQFAAVFGDIAHQFGKQGMAHAVFCPTCRTVLIIGFHTFAADGFQVAGMLADQSDNILFRQAFNRITDLFFAVVGFAFAALSQIQTGNRRIVDIYDFENRFRRALYRVLRLYRRIXGFAATAXQQAAAQYGKXXXQHSTXLMVSKCRLKRGRRRFGRHRVHFNGRMPTASGTLSNNSRASLRAFAAPACKISSICEGSAVSSL

SEQ ID NO: 701 - DNA, 474 bp, Neisseria meningitidis
atggcggcggcggaaataaaacgccccctcgctgtcgatttccagcacatagcgtccgttctgcacggcggcatagccgcttttgcctgcctgatagggttgcagggcggaatgcgaaatcaggtaatccgtcagtttgccgccgtcttcggcgatattgcccaccagtttggcaaacaaggtatggcacacgccgtttgccgcccagcccgaaggcgcgccctttccgtcggtttccatacatttgccgacgacggcttccaagtcgttgggatgcttgccggtcagccggacgacgttttgttccggcaagcctttaagaggttcggacggcattgggtttatttcaacgggcggataccgaccgcatcacgtactttgcccaataattcgcgtgcttctttacgcgctttttgcgcgcctgcctgcaaaatctcttcgatttgcgaagggtcggcggtcagctcgttgtag

SEQ ID NO: 702 - protein, 157 aa, Neisseria meningitidis
MAAAEIKRPLAVDFQHIASVLHGGIAAFACLIGLQGGMRNQVIRQFAAVFGDIAHQFGKQGMAHAVCRPARRRALSVGFHTFADDGFQVVGMLAGQPDDVLFRQAFKRFGRHWVYFNGRIPTASRTLPNNSRASLRAFCAPACKISSICEGSAVSSL

SEQ ID NO: 703 - DNA, 546 bp, Neisseria gonorrhoeae
atgctgaaaataccttttgccgtgttgggcggctgcctgctgcttgccgcctgcggcaaatccgaaaatacggcggaacagccgcaaaatgcggcacaaagcgcgccgaaaccggttttcaaagtcaaatacatcgacaatacggcgattgccggtttggctttgggacaaagtagcgaaggcaaaaccaacgacggcaaaaaacaaatcagttatccgattaaaggcttgccggaacaaaacgccgtccggctgaccggaaagcatcccaacgacttggaagccgtcgtcggcaaatgtatggaaaccgacggaaaggacgcgccttcgggctgggcggaaaacggcgtgtgccataccttgtttgccaaactggtgggcaatatcgccgaagacggcggcaaactgactgattacctgatttcgcattccgccctgcaaccctatcaggcaggcaaaagcggctatgccgccgtgcagaacggacgctatgtgctggaaatcgacagcgagggggcgttttatttccgccgccgccattattga

SEQ ID NO: 704 - protein, 181 aa, Neisseria gonorrhoeae
MLKIPFAVLGGCLLLAACGKSENTAEQPQNAAQSAPKPVFKVKYIDNTAIAGLALGQSSEGKTNDGKKQISYPIKGLPEQNAVRLTGKHPNDLEAVVGKCMETDGKDAPSGWAENGVCHTLFAKLVGNIAEDGGKLTDYLISHSALQPYQAGKSGYAAVQNGRYVLEIDSEGAFYFRRRHY

SEQ ID NO: 705 - DNA, 545 bp, Neisseria meningitidis
atgctgaawacwtyttttgccgtattgggcggctgcctgctgcyttgccgtgcggcaaatccgwaaatacggcggtacagccgcaaaacgcggtacaaagcgcgccgaaaccggttttcaaagtcatatatatcgacaatacggcgattgccggtttggatttgggacaaagcagcgaaggcaaaaccaacgacggcaaaaaacaaatcagttatccgattaaaggcttgccggaacaaaatgttatccgactgatcggcaagcatcccggcgacttggaagccgtcagcggcaaatgtatggaaaccgatgataaggacagtccggcaggttgggcagaaaacggcgtgtgccataccttgtttgccaaactggtgggcaatatcgccgaagacggcggcaaactgacggattacctagtttcgcatgccgccctgcaaccctatcaggcaggcaaaagcggctatgccgccgtgcagaacggacgctatgtgctggaaatcgacagcgaaggggcgttttatttccgccgccgccattattga

SEQ ID NO: 706 - protein, 181 aa, Neisseria meningitidis
  misc_feature (3)..(3): Xaa can be any naturally occurring amino acid
  misc_feature (5)..(5): Xaa can be any naturally occurring amino acid
  misc_feature (15)..(15): Xaa can be any naturally occurring amino acid
  misc_feature (22)..(22): Xaa can be any naturally occurring amino acid
MLXTXFAVLGGCLLXCRCGKSXNTAVQPQNAVQSAPKPVFKVIYIDNTAIAGLDLGQSSEGKTNDGKKQISYPIKGLPEQNVIRLIGKHPGDLEAVSGKCMETDDKDSPAGWAENGVCHTLFAKLVGNIAEDGGKLTDYLVSHAALQPYQAGKSGYAAVQNGRYVLEIDSEGAFYFRRRHY

SEQ ID NO: 707 - DNA, 336 bp, Neisseria meningitidis
tccgaacctcttaaaggcttgccggaacaaaacgtcgtccggctgaccggcaagcatcccaacgacttggaagccgtcgtcggcaaatgtatggaaaccgacggaaagggcgcgccttcgggctgggcggcaaacggcgtgtgccataccttgtttgccaaactggtgggcaatatcgccgaagacggcggcaaactgacggattacctgatttcgcattccgccctgcaaccctatcaggcaggcaaaagcggctatgccgccgtgcagaacggacgctatgtgctggaaatcgacagcgagggggcgttttatttccgccgccgccattattga

SEQ ID NO: 708 - protein, 111 aa, Neisseria meningitidis
SEPLKGLPEQNVVRLTGKHPNDLEAVVGKCMETDGKGAPSGWAANGVCHTLFAKLVGNIAEDGGKLTDYLISHSALQPYQAGKSGYAAVQNGRYVLEIDSEGAFYFRRRHY

SEQ ID NO: 709 - DNA, 524 bp, Neisseria gonorrhoeae
atgctgaaaataccttttgccgtgttgggcggctgcctgctgcttgccgcctgcggcaaatccgaaaatacggcggaacagccgcaaaatgcggcacaaagcgcgccgaaaccggttttcaaagtcaaatacatcgacaatacggcgattgccggtttggctttgggacaaagtagcgaaggcaaaaccaacgacggcaaaaaacaaatcagttatccgattaaaggcttgccggaacaaaacgccgtccggctgaccggaaagcatcccaacgacttggaagccgtcgtcggcaaatgtatggaaaccgacggaaaggacgcgccttcgggctgggcggaaaacggcgtgtgccataccttgtttgccaaactggtgggcaatatcgccgaagacggcggcaaactgactgattacctgatttcgcattccgccctgcaaccctatcaggcaggcaaaagcggctatgccgccgtgcagaacggacgctatgtgctggaaatcgacagcgagggggcgtttta

SEQ ID NO: 710 - protein, 174 aa, Neisseria gonorrhoeae
MLKIPFAVLGGCLLLAACGKSENTAEQPQNAAQSAPKPVFKVKYIDNTAIAGLALGQSSEGKTNDGKKQISYPIKGLPEQNAVRLTGKHPNDLEAVVGKCMETDGKDAPSGWAENGVCHTLFAKLVGNIAEDGGKLTDYLISHSALQPYQAGKSGYAAVQNGRYVLEIDSEGAF

SEQ ID NO: 711 - DNA, 546 bp, Neisseria meningitidis
atgctgaaaacatcttttgccgtattgggcggctgcctgctgcttgccgcctgcggcaaatccgaaaatacggcggaacagccgcaaaacgcggtacaaagcgcgccgaaaccggttttcaaagtcaaatatatcgacaatacggcgattgccggtttggatttgggacaaagcagcgaaggcaaaaccaacgacggcaaaaaacaaatcagttatccgattaaaggcttgccggaacaaaatgttatccgactgatcggcaagcatcccggcgacttggaagccgtcagcggcaaatgtatggaaaccgatgataaggacagtccggcaggttgggcagaaaacggcgtgtgccataccttgtttgccaaactggtgggcaatatcgccgaagacggcggcaaactgacggattacctagtttcgcatgccgccctgcaaccctatcaggcaggcaaaagcggctatgccgccgtgcagaacggacgctatgtgctggaaatcgacagcgaaggggcgttttatttccgccgccgccattattga

SEQ ID NO: 712 - protein, 181 aa, Neisseria meningitidis
MLKTSFAVLGGCLLLAACGKSENTAEQPQNAVQSAPKPVFKVKYIDNTAIAGLDLGQSSEGKTNDGKKQISYPIKGLPEQNVIRLIGKHPGDLEAVSGKCMETDDKDSPAGWAENGVCHTLFAKLVGNIAEDGGKLTDYLVSHAALQPYQAGKSGYAAVQNGRYVLEIDSEGAFYFRRRHY

SEQ ID NO: 713 - DNA, 330 bp, Neisseria meningitidis
cctcttaaaggcttgccggaacaaaacgtcgtccggctgaccggcaagcatcccaacgacttggaagccgtcgtcggcaaatgtatggaaaccgacggaaagggcgcgccttcgggctgggcggcaaacggcgtgtgccataccttgtttgccaaactggtgggcaatatcgccgaagacggcggcaaactgacggattacctgatttcgcattccgccctgcaaccctatcaggcaggcaaaagcggctatgccgccgtgcagaacggacgctatgtgctggaaatcgacagcgagggggcgttttatttccgccgccgccattattga

SEQ ID NO: 714 - protein, 109 aa, Neisseria meningitidis
PLKGLPEQNVVRLTGKHPNDLEAVVGKCMETDGKGAPSGWAANGVCHTLFAKLVGNIAEDGGKLTDYLISHSALQPYQAGKSGYAAVQNGRYVLEIDSEGAFYFRRRHY

SEQ ID NO: 715 - DNA, 534 bp, Neisseria gonorrhoeae
atgttttcccccgacaaaacccttttcctctgtctcggcgcactgctcctcgcctcatgcggcacgacctccggcaaacaccgccaaccgaaacccaaacagacagtccggcaaatccaagccgtccgcatcagccacatcggccgcacacaaggctcgcaggaactcatgctccacagcctcggactcatcggcacgccctacaaatggggcggcagcagcaccgcaaccggcttcgactgcagcggcatgattcaattggtttacaaaaacgccctcaacgtcaagctgccgcgcaccgcccgcgacatggcggcggcaagccgcaaaatccccgacagccgcctcaaggccggcgacatcgtattcttcaacaccggcggcgcacaccgctactcacacgtcggactctacatcggcaacggcgaattcatccatgcccccggcagcggcaaaaccatcaaaaccgaaaaactctccacaccgttttacgccaaaaactaccttggagcgcatacgttttttacagaatga

SEQ ID NO: 716 - protein, 177 aa, Neisseria gonorrhoeae
MFSPDKTLFLCLGALLLASCGTTSGKHRQPKPKQTVRQIQAVRISHIGRTQGSQELMLHSLGLIGTPYKWGGSSTATGFDCSGMIQLVYKNALNVKLPRTARDMAAASRKIPDSRLKAGDIVFFNTGGAHRYSHVGLYIGNGEFIHAPGSGKTIKTEKLSTPFYAKNYLGAHTFFTE

SEQ ID NO: 717 - DNA, 534 bp, Neisseria meningitidis
atgtttccccccgacaaaacccttttcctctgtctcagcgcactgctcctcgcctcatgcggcacgacctccggcaaacaccgccaaccgaaacccaaacagacagtccggcaaatccaagccgtccgcatcagccacatcgaccgcacacaaggctcgcaggaactcatgctccacagcctcggactcatcggcacgccctacaaatggggcggcagcagcaccgcaaccggcttcgattgcagcggcatgattcaattcgtttacaaraacgccctcaacgtcaagctgccgcgcaccgcccgcgacatggcggcggcaagccgsaaaatccccgacagccgcytcaaggccggcgacctcgtattcttcaacaccggcggcgcacaccgctactcacacgtcggactctacatcggcaacggcgaattcatccatgcccccagcagcggcaaaaccatcaaaaccgaaaaactctccacaccgttttacgccaaaaactacctcggcgcacatactttttttacagaatga

SEQ ID NO: 718 - protein, 177 aa, Neisseria meningitidis
  misc_feature (116)..(116): Xaa can be any naturally occurring amino acid
MFPPDKTLFLCLSALLLASCGTTSGKHRQPKPKQTVRQIQAVRISHIDRTQGSQELMLHSLGLIGTPYKWGGSSTATGFDCSGMIQFVYKNALNVKLPRTARDMAAASRKIPDSRXKAGDLVFFNTGGAHRYSHVGLYIGNGEFIHAPSSGKTIKTEKLSTPFYAKNYLGAHTFFTE

SEQ ID NO: 719 - DNA, 534 bp, Neisseria meningitidis
atgtttccccccgacaaaacccttttcctctgtctcagcgcactgctcctcgcctcatgcggcacgacctccggcaaacaccgccaaccgaaacccaaacagacagtccggcaaatccaagccgtccgcatcagccacatcgaccgcacacaaggctcgcaggaactcatgctccacagcctcggactcatcggcacgccctacaaatggggcggcagcagcaccgcaaccggcttcgattgcagcggcatgattcaattcgtttacaaaaacgccctcaacgtcaagctgccgcgcaccgcccgcgacatggcggcggcaagccgcaaaatccccgacagccgccttaaggccggcgacctcgtattcttcaacaccggcggcgcacaccgctactcacacgtcggactctatatcggcaacggcgaattcatccatgcccccagcagcggcaaaaccatcaaaaccgaaaaactctccacaccgttttacgccaaaaactacctcggcgcacatactttctttacagaatga

SEQ ID NO: 720 - protein, 177 aa, Neisseria meningitidis
MFPPDKTLFLCLSALLLASCGTTSGKHRQPKPKQTVRQIQAVRISHIDRTQGSQELMLHSLGLIGTPYKWGGSSTATGFDCSGMIQFVYKNALNVKLPRTARDMAAASRKIPDSRLKAGDLVFFNTGGAHRYSHVGLYIGNGEFIHAPSSGKTIKTEKLSTPFYAKNYLGAHTFFTE

SEQ ID NO: 721 - DNA, 780 bp, Neisseria gonorrhoeae
atgctgcggcatttaggaaacgacttcgccttgggcgcgttgtttttcgatgctgcggttgatgtgccactgctgggcgatggtcaggaggttgttgaccacccagtagagaaccaaaccggcagggaagaagaagaacatgacggagaaaaccaacggcatgattttcatcattttcgcctgcatcgggtcggtcggcggcgggttcagataggtttgggcgaacatcgttgccgccataatgatgggcaggatgtagtaggggtcggcgcggctgaggtcggtaatccagcccagccaaggtgcctggcgcaattctacggaggcgaacaatgcccagtacaagccgatgaagacggggatttgcaacagcataggcagacagccgcccagcgggttgatttcctcgtcttcgaaaagctgcatcatcgcttgctgttgcgccatacggtcgtcgccgtatttttctttgatggtctgcagttcgggtgcggcggcacgcattttcgccatcgaacggtaggaggcgttggtcaatggatacagtacggctttgacgatgatggtcaaaacgacgattgcccagccccagttgccgataatgttgtgcagttggttcaggagccagaagagcggcgatgcgaaccagtgtactttaccgtagtcttttgccagttgcaggttgtcggcgatgtttgcgataacggatgtggtttgcggaccggcatacaggttgaccgccattttcggttttggcccccgggttgggatagcggttaa

SEQ ID NO: 722 - protein, 259 aa, Neisseria gonorrhoeae
MLRHLGNDFALGALFFDAAVDVPLLGDGQEVVDHPVENQTGREEEEHDGENQRHDFHHFRLHRVGRRRVQIGLGEHRCRHNDGQDVVGVGAAEVGNPAQPRCLAQFYGGEQCPVQADEDGDLQQHRQTAAQRVDFLVFEKLHHRLLLRHTVVAVFFFDGLQFGCGGTHFRHRTVGGVGQWIQYGFDDDGQNDDCPAPVADNVVQLVQEPEERRCEPVYFTVVFCQLQVVGDVCDNGCGLRTGIQVDRHFRFWPPGWDSG

SEQ ID NO: 723 - DNA, 1025 bp, Neisseria meningitidis
atgctgcggcatttaggaaacgacttcgccttggggcgttgtttttcgatgctgcggttgatgtgccattgctgggcgatggtcaggaggttgttgactacccagtacaataccagaccggcagggaagaagaagaacatgacggagaaaaccaacggcatgattttcatcattttcgcctgcatcgggtcggtcggcggcgggttcagataagtttgggcgaacatcgttgccgccataatgatgggcaggatgtagtaggggtcggcgcggctgaggtcggtaatccaacccagccaaggtgcctggcgcaattctacggaggcgaacaatgcccaatacaatccgatgaagacggggatttgcaacagcataggcaggcagccgcccagcgggttgattttctcgtctgtgtaaagctgcatcatcgcctgttgttgcgccatacggtcgtcgccgtatttctctttgatggcttgcagtttgggtgcggcggcacgcattttcgccatagagcggtaagaggcgttggtcaatggatacagtacggctttgacgatgatggttaaaacgataatcgcccagccccagttgccgatgatgttgtgcagttggttcaggagccagaagagcggggaggcgaaccagtgtactttgccgtagtctttggccagttgcaggttgtcggcgatgtttgcgatgacggatgtggtctgcgggccggcgtagaggttgatggaggcttcggtttcgcgccgttttggatggcggctaaaggcacgctgacgctggtgctgtacagcttgtcgttgcggcgtttgatgtcgatgttgcactcgcctgcggcgcaaacgctttgtctgcctttaggttggagaatccaggtggacatgaagtggtgttcaatcatgccgagccagccggtcggggttttgcggatgtattcggcctcggatttgccggatttggcatcgtcgtccaagtcggaaaagctgactttttggaagttgccttcaggggtataa

SEQ ID NO: 724 - protein, 340 aa, Neisseria meningitidis
MLRHLGNDFALGALFFDAAVDVPLLGDGQEVVDYPVQYQTGREEEEHDGENQRHDFHHFRLHRVGRRRVQISLGEHRCRHNDGQDVVGVGAAEVGNPTQPRCLAQFYGGEQCPIQSDEDGDLQQHRQAAAQRVDFLVCVKLHHRLLLRHTVVAVFLFDGLQFGCGGTHFRHRAVRGVGQWIQYGFDDDGNDNRPAPVADDVVQLVQEPEERGGEPVYFAVVFGQLQVVGDVCDDGCGLRAGVEVDGGFGFAPFWMAAKGTLTLVLYSLSLRRLMSMLHSPAAQTLCLPLGWRIQVDMKWCSIMPSQPVGVLRMYSASDLPDLASSSKSEKLTFWKLPSGV

SEQ ID NO: 725 - DNA, 1026 bp, Neisseria meningitidis
atgctgcggcatttaggaaacgacttcgccttgggcgcgttgtttttcgatgctgcggttgatgtgccattgctgggcgatggtcaggaggttgttgatcacccagtacaataccagaccggcagggaagaagaagaacatgacggagaaaaccaaaggcatgattttcatcattttcgcctgcatcgggtcggtcggcggcgggttcagataggtttgggcgaacatcgttgccgccataatgatgggcaggatgtagtaggggtcggcgcggctgaggtcggtaatccaacccagccaaggtgcctggcgcaattctacggaggcgaacaatgcccaatacaatccgatgaagacggggatttgcaacagcataggcaggcagccgcccagcgggttgattttctcgtctgtgtaaagctgcatcatggcttgttgctgcgccatacggtcgtcgccgtatttctctttgatggcttgcagtttgggcgcggcggcacgcattttcgccatcgaacggtaagaggcgttggtcaatggatacagtacggctttgacgatgatggttaaaacgataatcgcccagccccagttgccgatgatgttgtgcagttggttcaaaagccaaaagaggggggaggcgaaccagtgtactttgccgtagtctttggccagttgcaggttgtcggcgatgtttgcgataacggatgtggtctgtgggccggcgtagaggttgatggaggcttcggtttcgcaccgttttggatagcggctaaaggcacgctgacgctggtgctgtacagcttgtcgttgcggcgtttgatgtcgatacggcagtcgccagcggcgcaaacgctttgtccgcctttgggttggaggatccaggtggacatgaagtggtgttcaatcatgccgagccagccggtcggggttttgcggatgtattcggcctcggatttgccggatttggcatcgtcgtccaagtcggagaagctgactttttggaagttgccttcaggggtataa

SEQ ID NO: 726 - protein, 340 aa, Neisseria meningitidis
MLRHLGNDFALGALFFDAAVDVPLLGDGQEVVDHPVQYQTGREEEEHDGENQRHDFHHFRLHRVGRRRVQIGLGEHRCRHNDGQDVVGVGAAEVGNPTQPRCLAQFYGGEQCPIQSDEDGDLQQHRQAAAQRVDFLVCVKLHHGLLLRHTVVAVFLFDGLQFGRGGTHFRHRTVRGVGQWIQYGFDDDGNDNRPAPVADDVVQLVQKPKEGGGEPVYFAVVFGQLQVVGDVCDNGCGLWAGVEVDGGFGFAPFWIAAKGTLTLVLYSLSLRRLMSIRQSPAAQTLCPPLGWRIQVDMKWCSIMPSQPVGVLRMYSASDLPDLASSSKSEKLTFWKLPSGV

SEQ ID NO: 727 - DNA, 525 bp, Neisseria gonorrhoeae
atgttgcggattgctgctgccaatcagttgggcggtcgaaatggtgcggcggtgggaaacggggtcgataagtttgggcgtggtgctgataatcaggttgagtttttggaaggaaacctgattgtagtcggcgcgtccgggcgtgccgctgtaacggtagccgtggcgcaattcgagcgtgcgtttgttgtccttcagcgagaagttaccttctttggcgaagatgatgttgtcgccgccgtttttgtcctgttcgcgcaggaacaggtttttcatgatgccggattcggtgtcaaaggtttcgacgaaataaaccctgccgttgcgcttgcccaagttattgaactcgccggcttccaccaaagacaattcctgcttctgcttcaaaatttcggcatattcgcggctgcgcagctctgcccacggtatcacccaaagctgcatgacggcaatcaggatggcaaacggcacggcaaactgcatgacggggcgtatccactgtttcaacgccaatccgcaggatag

SEQ ID NO: 728 - protein, 174 aa, Neisseria gonorrhoeae
MLRIAAANQLGGRNGAAVGNGVDKFGRGADNQVEFLEGNLIVVGASGRAAVTVAVAQFERAFVVLQREVTFFGEDDVVAAVFVLFAQEQVFHDAGFGVKGFDEINPAVALAQVIELAGFHQRQFLLLLQNFGIFAAAQLCPRYHPKLHDGNQDGKRHGKLHDGAYPLFQRQSAG

SEQ ID NO: 729 - DNA, 525 bp, Neisseria meningitidis
atgttgcgggttgctgctgccaatcagttgggcggtcggaatggtacggcggtgggaaacggggtcgatgagtttgggcgtggtgctgataatcaggttgagtttttggaaggaaacctgattgtagtcggcgcgtccgggcgtgccgctgtaacggtagccgtggcgcaattcgagcgtgcgtttgttgtcgttcagcgagaagttaccttctttggcgaagatgatgttgtcgccgccgtttttgtcctgttcgcgcaggaacaggtttttcatgatgccggattcggtatcgaaggtttcgacaaaataaaccctgccgttgcgcttgcccaaactgttgaactcgcctgcctccaccaaagacaattcctgcttctgcttcaggatttcagcgtattcgcggctgcgtagctctgcccacggtatcacccaaagctgcatgacggcaaccaaaacggcaaacggcacggcaaactgcatcaccgggcgtatccattgtttcaatgccaatccgcaggatag

SEQ ID NO: 730 - protein, 174 aa, Neisseria meningitidis
  misc_feature (138)..(138): Xaa can be any naturally occurring amino acid
MLRVAAANQLGGRNGTAVGNGVDEFGRGADNQVEFLEGNLIVVGASGRAAVTVAVAQFERAFVVVQREVTFFGEDDVVAAVFVLFAQEQVFHDAGFGIEGFDKINPAVALAQTVELACLHQRQFLLLLQDFSVFAAAXLCPRYHPKLHDGNQNGKRHGKLHHRAYPLFQCQSAG

SEQ ID NO: 731 - DNA, 525 bp, Neisseria meningitidis
atgttgcgggttgctgctgccaatcagttgggcggtcggaatggtacggcggtgggaaacggggtcgatgagtttgggcgtggtgctgataatcaggttgagtttttggaaggaaacctgattgtagtcggcgcgtccgggcgtgccgctgtaacggtagccgtggcgcaattcgagcgtgcgtttgttgtcgttcagcgagaagttactttctttggcgaagatgatgttgtcgccgccgtttttgtcctgttcgcgcaggaacaggtttttcatgatgccggattcggtatcgaaggtttcgacaaaataaaccctgccgttgcgcttgcccaaactgttgaacccgcctgcctccaccaaagacaattcctgcttctgcttcaggatttcagcgtattcgcggctgcgtagctctgcccacggtatcacccaaagctgcatgacggcaaccaaaacggcaaacggcacggcaaactgcatcaccgggcgtatccattgtttcaatgccaatccgcaggatag

SEQ ID NO: 732 - protein, 173 aa, Neisseria meningitidis
MLRVAAANQLGGRNGTAVGNGVDEFGRGADNQVEFLEGNLIVVGASGRAAVTVAVAQFERAFVVVQREVTFFGEDDVVAAVFVLFAQEQVFHDAGFGIEGFDKINPAVALAQTVEPACLHQRQFLLLLQDFSVFAAALCPRYHPKLHDGNQNGKRHGKLHHRAYPLFQCQSAG

SEQ ID NO: 733 - DNA, 1263 bp, Neisseria gonorrhoeae
atggacaatctcgtatgggacggcattcccgacatccgcacactcgaccaaaccatccgcaaacacgcacacccgctcaacctgattgtctgcctccccgataatcagattcccgattttcaaaccgcacaagatgcttcggactcggaatgccgtctgaagcaccgtttggatcaggcaacccagtgcctccagttcgacagcatcaacctcatcgaacacatcctgcccgatgtccgcttctggctggttcccccttcacgcacccgccgcctgcacgaacacttccaccacatttcctggcagaccgaagccatcccgcaaaccgaaagcaagtccgacaaaccctggtttgcacttccacaaacatccgaacggaaaaaaccggaacacgtcctcgtcatcggtgcaggcattgccggcgcatcgaccgcccacgccttagcatcacacggcatttccgttaccgtattggaagcccgaaaagccgctcaagccgccagcggcaaccggcaagggctgctttacgccaaaatctcgccgcacgacaccggacagaccgaactgctgcttgccggctacggctacaccaaacgcctgctcggacacatcctgcccgactccgacacttggggcggcaacggcatcatccacctcaattacagccgcaccgaacaacaacgcaatcacgaattgggtttgcaaaaacaccataaccacctctaccgcagcatcacgtctgcagaagccgaaaaaatcgccggcatcccgctgaacacgccctacgccgaaccattatgcggactctactggcaacacggcgtatggctcaatccgcccgcattcgtccgcaccctcctcagccatccgctgatcgaactatatgaaaacacaacgttaaccggcatttcccacgacggagaaaagtggattgcaagcacgccaaacggcacatttaccgccacacacatcatctactgcaccggcgcgcacagcccctgcctgcccgaaaccaacctcgccgccctacccctcaggcaaatacgcggacaaaccggcctcacaccgtccaccccgttttccgaacaactgcgttgcgccgtttcaggcgaaagctacatcagcccgtcgtggcacggactgcactgctacggcgcgagttttattcccaacagcagcaataccggatggaacgaagccgaagaagcctcaaaccgccaagcattggcacaccttaaccccgcccttgccgaatcattgttt

SEQ ID NO: 734 - protein, 421 aa, Neisseria gonorrhoeae
MDNLVWDGIPDIRTLDQTIRKHAHPLNLIVCLPDNQIPDFQTAQDASDSECRLKHRLDQATQCLQFDSINLIEHILPDVRFWLVPPSRTRRLHEHFHHISWQTEAIPQTESKSDKPWFALPQTSERKKPEHVLVIGAGIAGASTAHALASHGISVTVLEARKAAQAASGNRQGLLYAKISPHDTGQTELLLAGYGYTKRLLGHILPDSDTWGGNGIIHLNYSRTEQQRNHELGLQKHHNHLYRSITSAEAEKIAGIPLNTPYAEPLCGLYWQHGVWLNPPAFVRTLLSHPLIELYENTTLTGISHDGEKWIASTPNGTFTATHIIYCTGAHSPCLPETNLAALPLRQIRGQTGLTPSTPFSEQLRCAVSGESYISPSWHGLHCYGASFIPNSSNTGWNEAEEASNRQALAHLNPALAESLF

SEQ ID NO: 735 - DNA, 1620 bp, Neisseria meningitidis
atggacaatctcgtatgggacggcattcccgacatccgcacactcgaccaagccatccgcaaacacgcacccccgctcaacctgattatctgcctccccgataatcagattcccgattttcaaaccgcacaagatgcttcggacgcggaatgccgtctgaagcaccgtttggatcaggcaatgcagtgcctccagttcgacagcatcaacctcatcgaacacatcctgcccgatgtccgcttctggctggttcccccttcacgcacccaccacctgcacgaacatttccaccacatttcctggcagaccgaagccatcccgcaaaccgaaagcaagcccgacaaaccctggtttgcacttccacaaacatccgaacggcaaaaaccggaacacatcctcgttatcggcgcgggcatatccggcgcggcaaccgcccacgccttagcatcacacggcatttccgttaccgtattggaagcccgaaaagccgcccaagccgccagcggcaaccgccaagggctgctctacgccaaaatctcgccgcacgacaccgaacagaccgaacttttgcttgccggctacggctacaccaaacgcctgctcggacacatcctgcccgaatccgaaacctggggcggcaacggcatcatccacctcaattacagccgcaccgaacaacaacgcaatcacgaattgggtttgcaaaaacaccataaccacctctaccgcagcatcacatctgcagaagccgaaaaaatcgccggtatcccactgtccgtcccatacgaccacccttcatgcggactctactggcaacacggcgtatggctcaatccacccgcattcgtccgcaccctcctcaaccatccgctcattggactacacgaagacacacccttgaccgacatttcccacgacggggaaaagtggattgcaagcacgccaaacggcacatttaccgccacacacatcatctactgcaccggtgcgaacagcccctacctacccgaaaccaacctcgccgccctgcctctcaggcaaatacgcggacaaaccggcctcacaccgtccaccccgttttccgaacaactgcgttgcgccgtttcaggcgaaagctacatcagcccgtcgtggcacggactgcactgctacggcgcgagttttattcccaacagcagccataccggatggaacgaagccgaagaagcctcaaaccgccaagcattggcacaccttaaccccgccctttccgaatcattgtttgccgccaacccaaacccccaaaaacaccaagggcacgccgccatacgctgcgacagccccgaccaccttcccctagtcggcgcactcggcgacattgccgccatgcggcagacctacaccaaactcgcgctggacaaaaactaccgcatcgacaccccatgcccatacctgcctaatgcctacgtcaacaccgcgcacggcacccgcggactcgccaccgcccccatctgcgccgccgmcawtgcagcccaaatcstaggcytgccccatcccttttyacaacgcctgcgccacgccctacaccccaaccgcaccatcatccgcgccatcgtcagaaggaaggatctaaccccttaa

SEQ ID NO: 736 - protein, 539 aa, Neisseria meningitidis
  misc_feature (501)..(502): Xaa can be any naturally occurring amino acid
  misc_feature (507)..(507): Xaa can be any naturally occurring amino acid
  misc_feature (514)..(514): Xaa can be any naturally occurring amino acid
MDNLVWDGIPDIRTLDQAIRKHAPPLNLIICLPDNQIPDFQTAQDASDAECRLKHRLDQAMQCLQFDSINLIEHILPDVRFWLVPPSRTHHLHEHFHHISWQTEAIPQTESKPDKPWFALPQTSERQKPEHILVIGAGISGAATAHALASHGISVTVLEARKAAQAASGNRQGLLYAKISPHDTEQTELLLAGYGYTKRLLGHILPESETWGGNGIIHLNYSRTEQQRNHELGLQKHHNHLYRSITSAEAEKIAGIPLSVPYDHPSCGLYWQHGVWLNPPAFVRTLLNHPLIGLHEDTPLTDISHDGEKWIASTPNGTFTATHIIYCTGANSPYLPETNLAALPLRQIRGQTGLTPSTPFSEQLRCAVSGESYISPSWHGLHCYGASFIPNSSHTGWNEAEEASNRQALAHLNPALSESLFAANPNPQKHQGHAAIRCDSPDHLPLVGALGDIAAMRQTYTKLALDKNYRIDTPCPYLPNAYVNTAHGTRGLATAPICAAXXAAQIXGLPHPFXQRLRHALHPNRTIIRAIVRRKDLTP

SEQ ID NO: 737 - DNA, 1620 bp, Neisseria meningitidis
atggacaatctcgcatggaacggcattcccgacatccgcacactcgaccaaaccatccgcaaacacgcacacccgctcaacctgattgtctgcctccccgataatcagattcccaattttcaaaccgcacaagatgcttcggacgcggaatgccgtctgaagcaccgtttggatcaggcaacccagtgcctccagttcgacagcatcaacctgattgaacacatcctgcccgatgtccgcttctggctggttcccccttcacgcacccgccgcctgcacgaacacttccaccacatttcctggcagaccgaagccatcccgcaaaccgaaagtaagcccgacaaaccctggtttgcacttccacaaacatccgaacggcaaaaaccggaacacatcctcgttatcggagcgggcatatccggcgcggcaaccgcccacgccttagcatcatacggcatttccgttaccgtattggaagcccgaaaagccgcccaagccgccagcggcaaccgccaagggctgctctacgccaaaatctcgccgcacgacaccgaacaaaccgaactgctgcttgccggctacggctacaccaaacgcctgctcggacatatcctgcccgaatccgaaacctggggcggcaacggcatcatccacctcaattacagccgcaccgaacaacaacgcaatcacgaattgggtttgcaaaaacaccataaccacctctaccgcagcatcacgcaggcagaagccgaaaaaatcgccggcatccctctgaacacgccctacgccgaaccattatgcggactgttttggcagtacggcgtatggctcaatcctcccacattcgtccgcgccctcctcagccatccgctcattggactacacgaagacacaccgttaaccgacatttcccacgacggggaaaagtggattgcaagcacgccaaacggcacatttaccgccacacacatcatctactgcaccggtgcgaacagcccctacctacccgaaaccaacctcgccaccctgcccctcaggcaaatacgcggacaaaccggcctcacaccgtccaccccgttttccgaacaactgcgttgcgccgtttcaggcgaaagctacatcagcccgtcgtggcacggactgcactgctacggcgcgagttttattcccaacagcagccataccggatggaacgaagccgaagaagcctcaaaccgccaagcattggcacaccttaaccccgccctttccgaatcattgtttgccgccaacccaaacccccaaaaacaccaagggcacgccgccatacgctgcgacagccccgaccaccttcccctagtcggcgcactcggcgacattgccgctatgcaacaaacttacgccaaactcgcgctggacaaaaactatcgcatcgatgccccctgcccgtacctgcccaatgcctacgccaacaccgcccacggcacacgcgggcttgccaccgcccccatctgcgccgccgccgttgcagccgaaatcctaggcttgccccatcccctctcaaaacgcctgcgccacgccctacaccccaaccgcgccatcatccgcgccatcgtcagaaggaaggatctaaccccttaa

SEQ ID NO: 738 - protein, 539 aa, Neisseria meningitidis
MDNLAWNGIPDIRTLDQTIRKHAHPLNLIVCLPDNQIPNFQTAQDASDAECRLKHRLDQATQCLQFDSINLIEHILPDVRFWLVPPSRTRRLHEHFHHISWQTEAIPQTESKPDKPWFALPQTSERQKPEHILVIGAGISGAATAHALASYGISVTVLEARKAAQAASGNRQGLLYAKISPHDTEQTELLLAGYGYTKRLLGHILPESETWGGNGIIHLNYSRTEQQRNHELGLQKHHNHLYRSITQAEAEKIAGIPLNTPYAEPLCGLFWQYGVWLNPPTFVRALLSHPLIGLHEDTPLTDISHDGEKWIASTPNGTFTATHIIYCTGANSPYLPETNLATLPLRQIRGQTGLTPSTPFSEQLRCAVSGESYISPSWHGLHCYGASFIPNSSHTGWNEAEEASNRQALAHLNPALSESLFAANPNPQKHQGHAAIRCDSPDHLPLVGALGDIAAMQQTYAKLALDKNYRIDAPCPYLPNAYANTAHGTRGLATAPICAAAVAAEILGLPHPLSKRLRHALHPNRAIIRAIVRRKDLTP

SEQ ID NO: 739 - DNA, 606 bp, Neisseria gonorrhoeae
atgatacaaaagatatgtaagctatttgttttaattgtaatttttgcaacttctcccgcttttgcccttcaaagcgacagcagacggcccatccaaatcgaagccgaccaaggttcgctcgatcaagccaaccaaaggaccacatttagcggcaatgtcatcatcagacagggtacgctcaacatttccgcctcgtgtgtcaacgtcacacgcggcaggcaaaggcggcgaatccgtgagggcggaaggttcgcccgtccgcttcagccaaacgttggacgggggcaaagggacggtgcgcggtcaggcaaacaacgttacctattcctccgcaggaagcactgtcgttctgaccggcaatgccaaagtgcagcgcggcggcgacgttgccgaaggtgcggtcattacctacaacaccaaaaccgaagtctataccatcaacggcagcacgaaatcgggtgcgaaatccgcttccaaaaccggcagggtcagcgtcgtcatccagccttcaagcacacaaaaaaccgaataaccccgatgccgtctgaaacggaaacgcagttcagacggcatttgccgaccgaaatgccgagaagagattattga

SEQ ID NO: 740 - protein, 201 aa, Neisseria gonorrhoeae
MIQKICKLFVLIVIFATSPAFALQSDSRRPIQIEADQGSLDQANQRTTFSGNVIIRQGTLNISASCVNVTRGRQRRRIREGGRFARPLQPNVGRGQRDGARSGKQRYLFLRRKHCRSDRQCQSAARRRRCRRCGHYLQHQNRSLYHQRQHEIGCEIRFQNRQGQRRHPAFKHTKNRITPMPSETETQFRRHLPTEMPRRDY

SEQ ID NO: 741 - DNA, 455 bp, Neisseria meningitidis
atgatacaaaagatatgtaagctatttgttttaatagcatttttttcggcgtcccccgcttttgcccttcaaagcgacagcaggcagcctattcagattgaggccgaccaaggttcgctcgatcaagccaaccaaagcaccacattcagcggaaacgtcgtcatcagacagggtacgctcaatatttccgccgcccgcgtcaatgttacacgcggcggcaaaggcggcgaatccgtgagggcggaaggttcgccagtccgcttcagccagacattggacggcggcaaaggcacggtgcgcggacaggcaaacaacgttgcttattcatctgcaggcagcaccgtagtcttaaccggtaatgccaaagtacagcgcggcggcgatgtcgccgaaggtgcggtgattacatacaacaccaaaaccgaagtctataccatcagcggcagcacaaaatt

SEQ ID NO: 742 - protein, 151 aa, Neisseria meningitidis
MIQKICKLFVLIAFFSASPAFALQSDSRQPIQIEADQGSLDQANQSTTFSGNVVIRQGTLNISAARVNVTRGRQRRRIREGGRFASPLQPDIGRRQRHGARTGKQRCLFICRQHRSLNRCQSTARRRCRRRCGDYIQHQNRSLYHQRQHKI

SEQ ID NO: 743 - DNA, 605 bp, Neisseria meningitidis
atgatacaaaagatatgtaagctatttgttttaatagcatttttttcggcgtcccccgcttttgcccttcaaagcgacagcaggcagcctattcagattgaggccgaccaaggttcgctcgatcaagccaaccaaagcaccacattcagcggaaacgtcgtcatcagacagggtacgctcaatatttccgccgcccgcgtcaatgttacacgcggcggcaaaggcggcgaatccgtgagggcggaaggttcgccagtccgcttcagccagacattggacggcggcaaaggcacggtgcgcggacaggcaaacaacgttgcttattcatctgcaggcagcaccgtagtcttaaccggtaatgccaaagtacagcgcggcggcgatgtcgccgaaggtgcggtgattacatacaacaccaaaaccgaagtctataccatcagcggcagcacaaaatccggcgcaaaatccgcttccaaatccggcagggtcagcgtcgttatccagccttcgagtacgcaaaaatccgaataatcccaatgccgtctgaaacataaacctggttcggacggcatttgccgaccgaaatattgaagagatatttatga

SEQ ID NO: 744 - protein, 199 aa, Neisseria meningitidis
  misc_feature (73)..(73): Xaa can be any naturally occurring amino acid
MIQKICKLFVLIAFFSASPAFALQSDSRQPIQIEADQGSLDQANQSTTFSGNVVIRQGTLNISAARVNVTRGXQRRRIREGGRFASPLQPDIGRRQRHGARTGKQRCLFICRQHRSLNRCQSTARRRCRRRCGDYIQHQNRSLYHQRQHKIRRKIRFQIRQGQRRYPAFEYAKIRIIPMPSETTWFGRHLPTEILKRYL

SEQ ID NO: 745 - DNA, 531 bp, Neisseria gonorrhoeae
atgatacaaaagatatgtaagctatttgttttaattgtaatttttgcaacttctcccgcttttgcccttcaaagcgacagcagacggcccatccaaatcgaagccgaccaaggttcgctcgatcaagccaaccaaagtaccacatttagcggcaatgtcatcatcagacagggtacgctcaacatttccgcctcgcgcgtcaacgtcacacgcggcggcaaaggcggcgaatccgtgagggcggaaggttcgcccgtccgcttcagccaaacgttggacgggggcaaagggacggtgcgcggtcaggcaaacaacgttacctattcctccgcaggaagcaccgtcgttctgaccggcaatgccaaagtgcagcgcggcggcgacgttgccgaaggtgcggtcattacctacaacaccaaaaccgaagtctataccatcaacggcagcacgaaatcgggtgcgaaatccgcttccaaaaccggcagggtcagcgtcgtcatccagccttcaagcacacaaaaaaccgaataa

SEQ ID NO: 746 - protein, 176 aa, Neisseria gonorrhoeae
MIQKICKLFVLIVIFATSPAFALQSDSRRPIQIEADQGSLDQANQSTTFSGNVIIRQGTLNISASRVNVTRGGKGGESVRAEGSPVRFSQTLDGGKGTVRGQANNVTYSSAGSTVVLTGNAKVQRGGDVAEGAVITYNTKTEVYTINGSTKSGAKSASKTGRVSVVIQPSSTQKTE

SEQ ID NO: 747 - DNA, 531 bp, Neisseria meningitidis
atgatacaaaagatatgtaagctatttgttttaatagcatttttttcggcgtcccccgcttttgcccttcaaagcgacagcaggcagcctattcagattgaggccgaccaaggttcgctcgatcaagccaaccaaagcaccacattcagcggaaacgtcgtcatcagacagggtacgctcaatatttccgccgcccgcgtcaatgttacacgcggcggcaaaggcggcgaatccgtgagggcggaaggttcgccagtccgcttcagccagacattggacggcggcaaaggcacggtgcgcggacaggcaaacaacgttgcttattcatctgcaggcagcaccgtagtcttaaccggtaatgccaaagtacagcgcggcggcgatgtcgccgaaggtgcggtgattacatacaacaccaaaaccgaagtctataccatcagcggcagcacaaaatccggcgcaaaatccgcttccaaatccggcagggtcagcgtcgttatccagccttcgagtacgcaaaaatccgaataa

SEQ ID NO: 748 - protein, 176 aa, Neisseria meningitidis
MIQKICKLFVLIAFFSASPAFALQSDSRQPIQIEADQGSLDQANQSTTFSGNVVIRQGTLNISAARVNVTRGGKGGESVRAEGSPVRFSQTLDGGKGTVRGQANNVAYSSAGSTVVLTGNAKVQRGGDVAEGAVITYNTKTEVYTISGSTKSGAKSASKSGRVSVVIQPSSTQKSE

SEQ ID NO: 749 - DNA, 531 bp, Neisseria meningitidis; identical to SEQ ID NO: 747

SEQ ID NO: 750 - protein, 176 aa, Neisseria meningitidis; identical to SEQ ID NO: 748

SEQ ID NO: 751 - DNA, 582 bp, Neisseria gonorrhoeae
atgaaagtaagatggcggtacggaattgcgttcccattgatattggcggttgccttgggcagcctgtcggcatggttgggccgtatcagcgaagtcgaaatcgaggaagtcaggctcaatcccgacgaacctcaatacacaatggacggcttggacggaaggcggtttgacgaacagggatacttgaaagaacatttgagcgcgaaaggtgcgaaacagtttcccgaaaacagcgacatccattttgattcgccgcatctcgtgttcttccaagaaggcaggctgttgtacgaagtcggcagcgatgaagccgtttaccataccgaaaacaaacaggttctttttaaaaacaacgttgtgctgaccaaaaccgccgacggcaggcggcaggcgggtaaagtcgaaaccgaaaaactgcacgtcgataccgaatctcaatatgcccaaaccgatacgcctgtcagtttccaatatggcgcgtcgcacggtcaggcgggcggtatgacctacaaccacaaaacaggcatgttgaacttctcatctaaagtgaaagccgcgatttatgatacaaaagatatgtaa

SEQ ID NO: 752 - protein, 193 aa, Neisseria gonorrhoeae
MKVRWRYGIAFPLILAVALGSLSAWLGRISEVEIEEVRLNPDEPQYTMDGLDGRRFDEQGYLKEHLSAKGAKQFPENSDIHFDSPHLVFFQEGRLLYEVGSDEAVYHTENKQVLFKNNVVLTKTADGRRQAGKVETEKLHVDTESQYAQTDTPVSFQYGASHGQAGGMTYNHKTGMLNFSSKVKAAIYDTKDM

SEQ ID NO: 753 - DNA, 521 bp, Neisseria meningitidis
agcctgtcggcatggttgggtcgtatcagcgaagtcgagattgaagaagtcaggctcaatcccgacgaaccgcaatacacaatggacagcttggacggcaggcggtttgacgaacagggatacttgaaagaacatttgagcgcgaagggcgcgaaacagtttccggaaagcagcgacatccattttgattcgccgcatctcgtgttcttccaagaaggcaggttgttgtacgaagtcggcagcgacgaagccgtttaccataccgaaaacaaacaggttctttttaaaaacaacgttgtgctgaccaaaaccgccgacggcaaacggcaggcgggtaaagttgaagccgaaaagctgcacgtcgataccgaatctcaatatgcccaaaccgatacgcctgcagtttccaatatggtgcatcgcacggtcaggcgggcggcatgacttacgaccacawwacaggcatgttgaacttctcatctaaagtgaaagccacgatttatgatacaaaagatatgtaa

SEQ ID NO: 754 - protein, 173 aa, Neisseria meningitidis
  misc_feature (153)..(153): Xaa can be any naturally occurring amino acid
SLSAWLGRISEVEIEEVRLNPDEPQYTMDSLDGRRFDEQGYLKEHLSAKGAKQFPESSDIHFDSPHLVFFQEGRLLYEVGSDEAVYHTENKQVLFKNNVVLTKTADGKRQAGKVEAEKLHVDTESQYAQTDTPVSFQYGASHGQAGGMTYDHXTGMLNFSSKVKATIYDTKDM

SEQ ID NO: 755 - DNA, 582 bp, Neisseria meningitidis
atgaaagtaagatggcggtacggaattgcgttcccattgatattggcggttgccttgggcagcctgtcggcatggttgggacgcatcagcgaagtcgagattgaagaagtcaggctcaatcccgacgaaccgcaatacacaatggacggattggatggcaggcggtttgacgaacagggatacttgaaagaacatttgagttcgaagggcgcgaaacagtttcccgaaagcagcgacattcatttcgactcaccgcatctcgtgttcttccaagaaggcaggttgttgtacgaagtcggcagcgatgaagccgtttaccataccgaaaacaaacaggttctttttaaaaacaacgttgtgctgaccaaaaccgccgacggcaaacggcaggcgggtaaagttgaagccgaaaagctgcacgtcgataccgaatctcaatatgcccaaaccgatacgcctgtcagtttccaatatggtgcatcgcacggtcaggcgggcggcatgacttacgaccacaaaacaggcatgttgaacttctcatctaaagtgaaagccacgatttatgatacaaaagatatgtaa

SEQ ID NO: 756 - protein, 193 aa, Neisseria meningitidis
MKVRWRYGIAFPLILAVALGSLSAWLGRISEVEIEEVRLNPDEPQYTMDGLDGRRFDEQGYLKEHLSSKGAKQFPESSDIHFDSPHLVFFQEGRLLYEVGSDEAVYHTENKQVLFKNNVVLTKTADGKRQAGKVEAEKLHVDTESQYAQTDTPVSFQYGASHGQAGGMTYDHKTGMLNFSSKVKATIYDTKDM

SEQ ID NO: 757 - DNA, 468 bp, Neisseria gonorrhoeae
atgatatcgatttcgagctcggtacccagcgacgaaatcaccgccatcatccccgcactcaaacgcaaagacattaccctcgtctgcatcaccgcccgccccgattcaaccatggcgcgccatgccgatatccacatcaccgcatcggtttcgcaagaagcctgcccgttggggcttgccccgaccaccagcaccaccgccgttatggctttgggcgacgcgttggcggtcgtcctgctgcgcgcccgcgcgttcacgcccgacgacttcgccttgatccaccctgccggcagcctcggcaaacgcctgcttttgcgcgttgccgacattatgcacaaaggcggcggcctgcccgccgtccgactcggcacgcccttgaaaggagccatcgtcagcatgagcgagaaaggtttgggcatgtgggcgggaacggacgggcaaaggctgtctgaaaggcctttttactga

SEQ ID NO: 758 - protein, 155 aa, Neisseria gonorrhoeae
MISISSSVPSDEITAIIPALKRKDITLVCITARPDSTMARHADIHITASVSQEACPLGLAPTTSTTAVMALGDALAVVLLRARAFTPDDFALIHPAGSLGKRLLLRVADIMHKGGGLPAVRLGTPLKGAIVSMSEKGLGMWAGTDGQRLSERPFY

SEQ ID NO: 759 - DNA, 981 bp, Neisseria meningitidis
atggcaatggcagaaaacggaaaatatctcgactgggcacgcgaagtgttgcacgccgaagcggaaggcttgcgcgaaattgcagcggaattgsacaaaaacttcgtccttgcggcagacgcgttgttgcactgcaagggcagggtcgttatcacgggcatggtcaagtcgggacatatcgggcgcaaaatggcggcaactatggcctcgaccggcacgcctgcgtttttcgtccaccctgcggaagcggcacacggcgatttgggtatgattgtggacarcgacgtggtcgtcgcgatttccaattccggcgaaagcgacgaaatcgccgccatcatccccgcactcaaacgcaaagacatcacgcttgtctgcatcaccgcccgccccgattcaaccatggcgcgccatgccgacatccacatcacggcgtcggtttccaaagaagcctgcccgctggggcttgccccgaccaccagcaccaccgccgtcatggctttgggcgatgcgttggcggtcgtcctgctgcgcgcacgcgcgttcacgcccgacgatttcgccttgagccatcctgccggcagcctcggcaaacgcctacttttgcgcgttgccgacattatgcacaaaggcggcggcctgcctgccgtccgactcggcacgcccttgaaagaagccatcgtcagcatgagtgaaaaagggctgggcatgttggcggtaacggacgggcaaggccgtctgaaaggcgtattcaccgacggcgatttgcgccgcctgtttcaagaatgcgacaattttaccggtctttcgatagacgaagtcatgcatacgcatcctaaaaccatctccgccgaacgtctcgccaccgaagccctgaaagtcatgcaggcaaaccatgtgaacgggcttctggttaccgatgcagatggcgtgctgatcggcgcgctgaatatgcacgacctgctggcggcacggattgtatag

SEQ ID NO: 760 - protein, 326 aa, Neisseria meningitidis
  misc_feature (32)..(32): Xaa can be any naturally occurring amino acid
  misc_feature (94)..(94): Xaa can be any naturally occurring amino acid
MAMAENGKYLDWAREVLHAEAEGLREIAAELXKNFVLAADALLHCKGRVVITGMVKSGHIGRKMAATMASTGTPAFFVHPAEAAHGDLGMIVDXDVVVAISNSGESDEIAAIIPALKRKDITLVCITARPDSTMARHADIHITASVSKEACPLGLAPTTSTTAVMALGDALAVVLLRARAFTPDDFALSHPAGSLGKRLLLRVADIMHKGGGLPAVRLGTPLKEAIVSMSEKGLGMLAVTDGQGRLKGVFTDGDLRRLFQECDNFTGLSIDEVMHTHPKTISAERLATEALKVMQANHVNGLLVTDADGVLIGALNMHDLLAARIV

SEQ ID NO: 761 - DNA, 981 bp, Neisseria meningitidis
atggcgatggcaggaaacgaaaaatatcttgattgggcacgcgaagtgttgcacaccgaagcggaaggcttgcgcgaaattgcggcggatttggacgaaaacttcgcccttgcggcggacgcgttgttgcactgcaaaggcagggtcgttatcacgggcatgggcaagtcgggacatatcgggcgcaaaatggcggcaaccatggcctcgaccggcacgcccgcgtttttcgtccaccctgcggaagcggcacacggcgatttgggcatgattgtggacaacgacgtggtcgtcgcgatttccaattccggtgaaagcgacgaaatcgccgccatcatccccgcgctcaaacgcaaagatatcacgcttgtctgcatcaccgcccgccccgattcaaccatggcgcgccatgccgacatccacatcacggcgtcggtttccaaagaagcctgcccgctggggcttgccccgaccaccagcaccaccgccgttatggctttgggcgatgcgttggcggttgtcctgctgcgcgcccgcgcgttcacgcccgacgacttcgccttgagccaccctgccggcagcctcggcaaacgcctacttttgcgcgttgccgacattatgcacaaaggcggcggcctgcctgccgtccgactcggcacgcccttgaaagaagccatcgtcagcatgagtgaaaaagggctgggcatgttggcggtaacggacgggcaaggccgtctgaaaggcgtattcaccgacggcgatttgcgccgcctgtttcaagaatgcgacaattttaccggtctttcgatagacgaagtcatgcatacgcatcctaaaaccatctccgccgaacgtctcgccaccgaagccctgaaagtcatgcaggcaaaccatgtgaacgggcttctggttaccgatgcagatggcgtgctgatcggcgcgctgaatatgcacgaccttttggcggcgcggattgtatag

SEQ ID NO: 762 - protein, 326 aa, Neisseria meningitidis
MAMAGNEKYLDWAREVLHTEAEGLREIAADLDENFALAADALLHCKGRVVITGMGKSGHIGRKMAATMASTGTPAFFVHPAEAAHGDLGMIVDNDVVVAISNSGESDEIAAIIPALKRKDITLVCITARPDSTMARHADIHITASVSKEACPLGLAPTTSTTAVMALGDALAVVLLRARAFTPDDFALSHPAGSLGKRLLLRVADIMHKGGGLPAVRLGTPLKEAIVSMSEKGLGMLAVTDGQGRLKGVFTDGDLRRLFQECDNFTGLSIDEVMHTHPKTISAERLATEALKVMQANHVNGLLVTDADGVLIGALNMHDLLAARIV

SEQ ID NO: 763 - DNA, 681 bp, Neisseria gonorrhoeae
atggcggatgacggtttgttgcggcaactgtccgaaaaacccagccaaagtgctctcttcctgccatttgacccattcgttttcgaggttttggactgccttttggtcatcgggcccggcttgaaacaatgtttcaagcaaatcccggcaacgcgccacccattcgccgaccgtcgcaggttgccgccatatccgggcaatatccgacagggtttcgaggaaggcggcaaaacgtccgaacatggcggtttgattcacgtcggcataccacgcgctgacatcctgccacatcgggttgccgccttcgggcagcatccagcccaatatcatacggtctgccgcctgcttccaggtaaacagctgatccgtgccgccgcgcatttctccgtccaatccccaatggacgttcaaatcggcaaccatatcgtgcaaaagcggcaaatcgtccccggtcagtccgaaacggcgcaacacgggcgcggtttccaaaagcgcgagcactttgccgacttcaaaacggctttccagcaagtcggacacgcactccaacgcataaaaaaacggttgccggcggctgattttcacgtccgaaacggaatacggcaatgcctgcgcgccgggttgcgcctgtccgaacacggcttccataaaaggcgtatagggttcgatattcggggttaa

SEQ ID NO: 764 - protein, 226 aa, Neisseria gonorrhoeae
MADDGLLRQLSEKPSQSALFLPFDPFVFEVLDCLLVIGPGLKQCFKQIPATRHPFADRRRLPPYPGNIRQGFEEGGKTSEHGGLIHVGIPRADILPHRVAAFGQHPAQYHTVCRLLPGKQLIRAAAHFSVQSPMDVQIGNHIVQKRQIVPGQSETAQHGRGFQKREHFADFKTAFQQVGHALQRIKKRLPAADFHVRNGIRQCLRAGLRLSEHGFHKRRIGFDIRG

SEQ ID NO: 765 - DNA, 681 bp, Neisseria meningitidis
atggcggatgacggtgtgcggcggcaactgtccggaaaattgcgccaattcggtttccgcctrccatttgacccattcgttttcaaggttttggactgacttttggtcatcggcttcagcttggaacaatgtttcaagcaaatcccggcaacgcgccacccattcgccgaccgttgcgggctgccgccatatccgtacaatatccgtcagggtttcgaggaaggcggcaaaacgtccgaacatggcggtttgattcacgtcggcataccacgcgctgacatcctgccacatcggattgccgcctttgggcagcatccagcccaatatcatgcgttctaccgcctgcttccaggtgaacagctgatccgtgccgccgcgcatttctccgtccaaaccccagtggacgttcaaatcggcaaccatgtcgtgcaaaagcggtaaatcgtcctcagtcagtccgaaacggcgcaacacgggcgcggtttctaaaagcacaagcactttatcgacttcaaatcggctttccaacaagtcgaacaggcatgacaaagcatgaaacagcggttggcggcggctgattttcacgtctgacacggaatacggcaatgcctgcgcaccgggctgcgcctgtccgaacacggcttcgataaaaggcgtataggattcgatattcggggttaa

SEQ ID NO: 766 - protein, 226 aa, Neisseria meningitidis
  misc_feature (33)..(33): Xaa can be any naturally occurring amino acid
  misc_feature (147)..(147): Xaa can be any naturally occurring amino acid
  misc_feature (163)..(163): Xaa can be any naturally occurring amino acid
  misc_feature (182)..(182): Xaa can be any naturally occurring amino acid
  misc_feature (197)..(197): Xaa can be any naturally occurring amino acid
MADDGVRRQLSGKLRQFGFRLPFDPFVFKVLDXLLVIGFSLEQCFKQIPATRHPFADRCGLPPYPYNIRQGFEEGGKTSEHGGLIHVGIPRADILPHRIAAFGQHPAQYHAFYRLLPGEQLIRAAAHFSVQTPVDVQIGNHVVQKRXIVLSQSETAQHGRGFXKHKHFIDFKSAFQQVEQAXQSMKQRLAAADFHVXHGIRQCLRTGLRLSEHGFDKRRIGFDIRG

SEQ ID NO: 767 - DNA, 681 bp, Neisseria meningitidis
gtggcggatgacggtgtgcagcggcaactgtccggaaaattgcgccaattcggtttccgcctgccatttgacccattcgttttcgaggctttggactgccttttggtcatcgccttcgacttggaacaatgtttcaagcaaatcccggcaacgcgccacccattcgtcaaccgtcgcaggttgccgccatatccgtacaatatccgtcagggtttcgaggaaggcggcaaaacgtccgaacagggcggtttggttcacgtcggcataccacgcgctgaccccctgccacatcggattgccgccttcgggcagcatccagcccaatatcatgcgttctaccgcctgcttccaggtgaacagctgatccgtgccgccgcgcatttctccgtccaaaccccagcggacgttcaaatcggcaaccatgtcgtgcaaaagcggcaaatcgtcctcagtcagtccgaaatggcgcaacacgggcgcggtttctaaaagcacaagcactttatcgacttcaaatcggctttccaacaagtcgaacaggcatgacaaagcatgaaacagcggttgtcggcggctgattttcacatccgaaacggaatacggcaatgcctgcgcgccgggctgcgcctgtccgaacacggcttcgataaaaggcgtataggattcgatattcggggttaa

SEQ ID NO: 768 - protein, 224 aa, Neisseria meningitidis
VADDGVQRQLSGKLRQFGFRLPFDPFVFEALDCLLVIAFDLEQCFKQIPATRHPFVNRRRLPPYPYNIRQGFEEGGKTSEQGGLVHVGIPRADPLPHRIAAFGQHPAQYHAFYRLLPGEQLIRAAAHFSVQTPADVQIGNHVVQKRQIVLSQSEMAQHGRGFKHKHFIDFKSAFQQVEQAQSMKQRLSAADFHIRNGIRQCLRAGLRLSEHGFDKRRIGFDIRG

SEQ ID NO: 769 - DNA, 657 bp, Neisseria gonorrhoeae
atggttgcggtggatccttatacggcaaaagtggtcaacaccatgccgcgcaatcagggttggtatcacactatggatgaaatccacggcgatatgatgctcggtgcggcaggcgattatcttttggaaacggcagcttcactgaccattattatggttgtcagcggcttgtacctttggtgggcgaaacagcgcggcattaaagcgatgctgctgccgccaaaaagcagggcgcgttcttggtggcggaatctgcacggcgcgtttggaacttgggtgtcgttgattttactgttgttctgcctgtcgggtattgcttgggcaggtatttggggcggcaaattcgtgcaggcttggaatcagttcccggccggcaaatggggtgtcgaaccgaaccccgtttcaatcgtgccgacccacggcgaggtattgaatgacggcaaggttaaggaagtgccgtggattttggagcttatgcctatgcctgtctcagggacgactgtgggtgaaaacggcattaaccccaccgagcccaataacattggaaaccgtcgaccgtttcgcgcgggaaatcggtttcaaagggcgttatcagttgaatttgcccaaaggcgaggacggggtatggactttgtcgcaggattctatgagttatga

SEQ ID NO: 770 - protein, 218 aa, Neisseria gonorrhoeae
MVAVDPYTAKVVNTMPRNQGWYHTMDEIHGDMMLGAAGDYLLETAASLTIIMVVSGLYLWWAKQRGIKAMLLPPKSRARSWWRNLHGAFGTWVSLILLLFCLSGIAWAGIWGGKFVQAWNQFPAGKWGVEPNPVSIVPTHGEVLNDGKVKEVPWILELMPMPVSGTTVGENGINPTEPNNIGNRRPFRAGNRFQRALSVEFAQRRGRGMDFVAGFYEL

SEQ ID NO: 771 - DNA, 654 bp, Neisseria meningitidis
  misc_feature (568)..(568): n is a, c, g, or t
atggtcgcggtcgatccttatacggcaaaagtggtcagtaccatgccgcgcaatcagggttggtattacacgatggatgaaatccacagcgatatgatgctcggtgcggcaggcgattatcttttggaaacggcagcttcactgaccattattatggttgtcagcggcttgtacctttggtgggtgaaacggcgcggcatcaaggcgatgctgctgccgtcaaaaggcarggcgcgttcttggtggcggaatctgcacggcacgtttggaacttgggtgtcgttgattttgctgttgttctgcctgtcgggtattgcttgggcgggtatttggggcggcaagttcgtacaggcttggagtcagttccctgccggtaaatggggtgtcgaaccgaaccccgtttcagtcgtgccgacccacggcgaggtattgaatgacggcaaggttaaggaagtgccgtgggttttggagcttacgcctatgcctgtttcagggacgacygtgggcaaagacggcattaaccctgacgagccgatgacattggaaaccgtcgaccgctttgcgcggngaaatcggtttcaaagggcgttatcagttgaatttgcccaaaggcgaggacggcgtatggactttgtcgcaggattctatgagtta

SEQ ID NO: 772 - protein, 218 aa, Neisseria meningitidis
  misc_feature (77)..(77): Xaa can be any naturally occurring amino acid
  misc_feature (190)..(190): Xaa can be any naturally occurring amino acid
MVAVDPYTAKVVSTMPRNQGWYYTMDEIHSDMMLGAAGDYLLETAASLTIIMVVSGLYLWWVKRRGIKAMLLPSKGXARSWWRNLHGTFGTWVSLILLLFCLSGIAWAGIWGGKFVQAWSQFPAGKWGVEPNPVSVVPTHGEVLNDGKVKEVPWVLELTPMPVSGTTVGKDGINPDEPMTLETVDRFARXNRFQRALSVEFAQRRGRRMDFVAGFYEL

SEQ ID NO: 773 - DNA, 653 bp, Neisseria meningitidis
atggtcgcggtcgatccttatacggcaaaagtggtcagtaccatgccgcgcaatcagggttggtattacgcgatggatgaaatccacagcgatatgatgctcggttcgacaggtgattatcttttggaaacggctgcatcgctgacgattatcatgataatcagcggtttgtacctttggtgggtgaaacggcgcggcatcaaggcgatgctgctgccgccaaaaggcagggcgcgttcttggtggcggaatctgcacggcgcgtttggaacttgggtgtcgttgattttactgttgttctgcctgtcgggtattgcttgggcaggtatttggggcggcaagttcgtgcaggcttggagtcagttcccggcaggcaaatggggtgtcgaaccgaaccctgtttcagtcgtgccgacccacggcgaggtattgaatgacggcaaggttaaggaagtgccgtgggttttggagcttacgcctatgcctgtttcagggacgactgtgggcaaagacggtattaaccctgacgagccgatgacattggaaaccgtcgaccgttttgcgcgggaaatcggtttcaaagggcgttatcagctgaatttgcccaaaggcgaggacggcgtatggactttgtcgcaggattctatgagtta

SEQ ID NO: 774 - protein, 218 aa, Neisseria meningitidis
  misc_feature (190)..(190): Xaa can be any naturally occurring amino acid
MVAVDPYTAKVVSTMPRNQGWYYAMDEIHSDMMLGSTGDYLLETAASLTIIMIISGLYLWWVKRRGIKAMLLPPKGRARSWWRNLHGAFGTWVSLILLLFCLSGIAWAGIWGGKFVQAWSQFPAGKWGVEPNPVSVVPTHGEVLNDGKVKEVPWVLELTPMPVSGTTVGKDGINPDEPMTLETVDRFARXNRFQRALSAEFAQRRGRRMDFVAGFYEL

SEQ ID NO: 775 - DNA, 642 bp, Neisseria gonorrhoeae
atgacggcaaggttaaggaagtgccgtggattttggagcttatgcctatgcctgtctcagggacgactgtgggtgaaaacggcattaaccccaccgagcccaataacattggaaaccgtcgaccgtttcgcgcgggaaatcggtttcaaagggcgttatcagttgaatttgcccaaaggcgaggacggggtatggactttgtcgcaggattctatgagttatgacatgatcagcccgtttgccgaccgcacggtacatatcgaccagtacagcggcgagattcttgccgacatccgttttgacgattacaacccgttcggcaaatttatggcggcaagcattgcgctgcatatggggactttgggctggtggagcgtgttggcgaacgtcgtgttctgccttgccgtgatttttatcggcatcagcggctgcgtgatgtggtggaaacgccgtccgtccggcgtggcgggcattgttcctccggcgcaaaaaatcaaactgcccgtctggtgggcgatggcattgccgctgctgttgattgcactgcttttcccgaccgcgctgcttgccattgccgtgatttggctgttggataccttgctgctgtcgcggattcctgtgttgaggaaatggtttaaatga

SEQ ID NO: 776 - protein, 213 aa, Neisseria gonorrhoeae
MTARLRKCRGFWSLCLCLSQGRLWVKTALTPPSPITLETVDRFAREIGFKGRYQLNLPKGEDGVWTLSQDSMSYDMISPFADRTVHIDQYSGEILADIRFDDYNPFGKFMAASIALHMGTLGWWSVLANVVFCLAVIFIGISGCVMWWKRRPSGVAGIVPPAQKIKLPVWWAMALPLLLIALLFPTALLAIAVIWLLDTLLLSRIPVLRKWFK

SEQ ID NO: 777 - DNA, 642 bp, Neisseria meningitidis
  misc_feature (135)..(135): n is a, c, g, or t
atgacggcaaggttaaggaagtgccgtgggttttggagcttacgcctatgcctgtttcagggacgacygtgggcaaagacggcattaaccctgacgagccgatgacattggaaaccgtcgaccgctttgcgcggngaaatcggtttcaaagggcgttatcagttgaatttgcccaaaggcgaggacggcgtatggactttgtcgcaggattctatgagttacgacatgatcagcccgtttgccgaccgcacggtacatatcgaccagtacagcggcaaaatccttgccgacatccgttttgacgattacaacccgttcggcaaatttatggcggcaagcattgcgctgcatatggggactctgggctggtggagcgtgttggcgaacgtcttgttctgccttgccgtcatttttatcggtatcagcggctgcgtgatgtggtggaaacgccgtccgaccggagcggtgggcatcgttccgccggcgcagaaagtcaagctgccggtttggtggatgatggcattgccgctattggcaatcgcactgctcttcccgacctcactgcttgccattgccgtgatttggctgttggatacgctgctgttgtcgcggattcctgttttgaggagatggtttaaatga

SEQ ID NO: 778 - protein, 213 aa, Neisseria meningitidis
  misc_feature (23)..(23): Xaa can be any naturally occurring amino acid
  misc_feature (35)..(35): Xaa can be any naturally occurring amino acid
MTARLRKCRGFWSLRLCLFQGRXWAKTALTLTSRXHWKPSTALRGEIGFKGRYQLNLPKGEDGVWTLSQDSMSYDMISPFADRTVHIDQYSGKILADIRFDDYNPFGKFMAASIALHMGTLGWWSVLANVLFCLAVIFIGISGCVMWWKRRPTGAVGIVPPAQKVKLPVWWMMALPLLAIALLFPTSLLAIAVIWLLDTLLLSRIPVLRRWFK

SEQ ID NO: 779 - DNA, 641 bp, Neisseria meningitidis
atgacggcaaggttaaggaagtgccgtgggttttggagcttacgcctatgcctgtttcagggacgactgtgggcaaagacggtattaaccctgacgagccgatgacattggaaaccgtcgaccgttttgcgcgggaaatcggtttcaaagggcgttatcagctgaatttgcccaaaggcgaggacggcgtatggactttgtcgcaggattctatgagttacgacatgatcagcccgtttgctgaccgcacggtgcatatcgaccagtacagcggcaagattcttgccgacatccgttttgacgattacaacccgttcggcaaatttatggcggcaagcattgcgctgcatatggggactttgggctggtggagcgtgttggcgaacgttttgttctgccttgccgtgatttttatcggcatcagcggctgcgtgatgtggtggaaacgccgtccgtccggcgcggtgggcatggttccgccggcgcaaaaaatcaagctgcccgtctggtgggcaatggcggtgccgctgctgctgattgcattgcttttcccgaccgcgttgcttgccattgccgtgatttggctgttggatacgctgctgttgtcgcggattcctgttttgaggagatggtttaaatga

SEQ ID NO: 780 - protein, 212 aa, Neisseria meningitidis
  misc_feature (44)..(44): Xaa can be any naturally occurring amino acid
MTARLRKCRGFWSLRLCLFQGRLWAKTVLTLTSRHWKPSTVLRXEIGFKGRYQLNLPKGEDGVWTLSQDSMSYDMISPFADRTVHIDQYSGKILADIRFDDYNPFGKFMAASIALHMGTLGWWSVLANVLFCLAVIFIGISGCVMWWKRRPSGAVGMVPPAQKIKLPVWWAMAVPLLLIALLFPTALLAIAVIWLLDTLLLSRIPVLRRWFK

SEQ ID NO: 781 - DNA, 558 bp, Neisseria gonorrhoeae
atgcacgaccacggcgccatggatcgccgcctccccgctttcggaagtctgatgcggcgagccgtaaatcadatcgacgctgacggatttgaaccctgcctcacgggcggcatcgatgacttctttggtttcttcgtagctttggatgcggttgactgccgcctgcactttggggtcgaaatcctgaatgccgacgctcatgcggttgaagccgagtctgccgagcatgaggacggtgtcgcggctgactttgcgcgggtcgatttcgatggaatattcgccggacggtatcagttcgaaatgtttgcggatcatgcggaagacacgttcgatctgttcgtcgctcaaaaaggtcggcgtgccgccgccgaagtgcagttgggcaagctggtgccgtccgttcagatgtggagcgagcagttccatttctttttcaagatattcgatgtaggtatcggcgcggcttttgtctttggtgatgattttgttgcagccgcagtagtagcagatggtgttgcaaaacggaatgtgaatgtaaagggaaagcggtttgtttaa

SEQ ID NO: 782 - protein, 185 aa, Neisseria gonorrhoeae
  misc_feature (24)..(24): Xaa can be any naturally occurring amino acid
MHDHGAMDRRLPAFGSLMRRAVNXIDADGFEPCLTGGIDDFFGFFVALDAVDCRLHFGVEILNADAHAVEAESAEHEDGVAADFARVDFDGIFAGRYQFEMFADHAEDTFDLFVAQKGRRAAAEVQLGKLVPSVQMWSEQFHFFFKIFDVGIGAAFVFGDDFVAAAVVADGVAKRNVNVKGKRFV

SEQ ID NO: 783 - DNA, 531 bp, Neisseria meningitidis
atggyggttttgatgcwcmgaagtctggtgcggcaggccgtaaatcaaatcgacgctgacggatttgaaccccgcttcgcgcgccgcatcgatgacttctttggtttcttcgtaactttggatgcggttgaccgccgcctgcactttggggtcgaaatcctgaatgccgatgctcatgcggttgaagccgagtctgccgagcatgaggacggtgtcgcggctgactttgcgcgggtcgatttcgatggagtattcgccggtggggattaactcgaaatgtttgcgtatcatgcggaagacacgttcgatctgttcgtcgctcaaaaaggtgcgtgccccgccgaagtgcagttgggcaagctggtgccgtccgttcagatgtggagcgagcagttccatttctttttcaagatattcgatgtaggcatcggcgcggcttttgtctttggtgatgattttgttgcagccgcagtagtagcagatggtgttgcagaacggaatgtgaatgtaaagggaaagcggtttgtttaa

SEQ ID NO: 784 - protein, 176 aa, Neisseria meningitidis
  misc_feature (2)..(2): Xaa can be any naturally occurring amino acid
  misc_feature (6)..(6): Xaa can be any naturally occurring amino acid
  misc_feature (90)..(90): Xaa can be any naturally occurring amino acid
MXVLMXRSLVRQAVNQIDADGFEPRFARRIDDFFGFFVTLDAVDRRLHFGVEILNADAHAVEAESAEHEDGVAADFARVDFDGVFAGGDXLEMFAYHAEDTFDLFVAQKGACPAEVQLGKLVPSVQMWSEQFHFFFKIFDVGIGAAFVFGDDFVAAAVVADGVAERNVNVKGKRFV

SEQ ID NO: 785 - DNA, 534 bp, Neisseria meningitidis
atggtggttttgatgctccgaagtctggtgcggcaggccgtaaatcaaatcgacgctgacggatttgaaccccgcttcgcgcgccgcatcgatgacttctttggtttcttcgtaactttggatgcggttgaccgccgcctgcactttggggtcgaaatcctgaatgccgatgctcatgcggttgaagccgagtctgccgagcatgaggacggtgtcgcggctgactttgcgcgggtcgatttcgatggagtattcgccggtggggattaactcgaaatgtttgcgtatcatgcggaagacacgttcgatttggtcgtcgctcaaaaaggtcggcgtgccgccgccgaagtgcagttgggcaagctggtgccgtccgttcagatgtggagcgagcagttccatttctttttcaagaaattcgatgtaggcatcggcgcggcttttgtctttggtgatgattttgttgcagccgcagtagtagcagatggtgttgcagaacggaatgtgaatgtaaagggaaagcggtttgtttaa

SEQ ID NO: 786 - protein, 176 aa, Neisseria meningitidis
MVVLMLRSLVRQAVNQIDADGFEPRFARRIDDFFGFFVTLDAVDRRLHFGVEILNADAHAVEAESAEHEDGVAADFARVDFDGVFAGGDLEMFAYHAEDTFDLVVAQKGRRAAAEVQLGKLVPSVQMWSEQFHFFFKKFDVGIGAAFVFGDDFVAAAVVADGVAERNVNVKGKRFV

SEQ ID NO: 787 - DNA, 360 bp, Neisseria gonorrhoeae
atggaattcaggcaccaggtagtggtagttggtgtcgaaccatttggtcatttcgatggcgaattggtctttgttgccgcgcgccagttggaagaattgttccaaaggcaggttttggctatcgaagccgaaacgggcgggaatcgcgcccgtggatacttgcaggtcgaggatgtgatggtagaaagtgaaatcacgtacagcaacgtaatcagcgttaggagcagcttggtgtttccagtttttctcgcgcaggtctttggcaacgtcgagcagctcttgttcactgatctctttgcgccagtatttttcttgggcgaatttcaattcacggaaggcgccgacacgcgggaagcctga

SEQ ID NO: 788 - protein, 119 aa, Neisseria gonorrhoeae
MEFRHQVVVVGVEPFGHFDGELVFVAARQLEELFQRQVLAIEAETGGNRARGYLQVEDVMVESEITYSNVISVRSSLVFPVFLAQVFGNVEQLLFTDLFAPVFFLGEFQFTEGADTREA

SEQ ID NO: 789 - DNA, 359 bp, Neisseria meningitidis
gtggaattcaggcaccaagtagtggtagttggtgtcgaaccatttggtcatttcgatagcgaattggtctttgttaccgcgcgccagttggaagaattgttccaaagacaggttttggctgtcgaagccgaagcgggcgggaatcgcgccggtggcgacttgcaggtcgaggatgtggtcgtagaaagtgaaatcsctacggcaacgaaatcggcgttggcagcgacctggtgtttccagtttttctcgcgcaagtctttagcaacagccagcaattcttgctcgctgatttctttgcgccagtatttttcttgtgcgaatttcaattcgcggaaggcgccgacacgcgggaagcctga

SEQ ID NO: 790 - protein, 119 aa, Neisseria meningitidis
  misc_feature (66)..(66): Xaa can be any naturally occurring amino acid
VEFRHQVVVVGVEPFGHFDSELVFVTARQLEELFQRQVLAVEAEAGGNRAGGDLQVEDVVVESEIXYGNEIGVGSDLVFPVFLAQVFSNSQQFLLADFFAPVFFLCEFQFAEGADTREA

SEQ ID NO: 791 - DNA, 360 bp, Neisseria meningitidis
gtggaattcaggcaccaagtagtggtagttggtgtcgaaccatttggtcatttcgatagcgaattggtctttgttaccgcgcgccagttggaagaattgttccaaagataggttttggctgtcgaagccgaagcgggcgggaatcgcgccggtggcgacttgcaggtcgaggatgtggtcgtagaaagtgaaatcgcctacggcaacgtaatcggcgttggcagcggcctggtgtttccagtttttctcgcgcaagtctttagcaacagccagcaattcttgctcgctgatttctttgcgccagtatttttcttgtgcgaatttcaattcgcggaaggcaccgacacgcgggaagcctga

SEQ ID NO: 792 - protein, 118 aa, Neisseria meningitidis
VEFRHQVVVVGVEPFGHFDSELVFVTARQLEELFQRVLAVEAEAGGNRAGGDLQVEDVVVESEIAYGNVIGVGSGLVFPVFLAQVFSNSQQFLLADFFAPVFFLCEFQFAEGTDTREA

SEQ ID NO: 793 - DNA, 669 bp, Neisseria gonorrhoeae
  misc_feature (250)..(250): n is a, c, g, or t
atggattcttttttcaaaccggcagtttgggcggttttgtggctgatgtttgccgtccgccccgcccttgccgacgagttgaccaacctgctcagcagccgcgagcagattctcagacagtttgccgaagacgaacagcccgttttacccgtcaaccgagcccccgcccggcgggcgggcaatgccgacgaactcatcggcggcgcgatggggcttaacgaacagcccgttgtacgcgtcaaccgagccnccgcccggcgggcgggcaatgccgacaaactcatcggcagcgcgatgcggcttttgggtattgcctaccgctacggcggcacatcggtgtctaccggttttgactgcagcggattcatgcagcacatcttcaaacgcgccatgggcatcaacctgccgcgcacgtcggcggaacaggcgcggatgggcgcacccgttgcccgaagcgaattgcagcccggggatatggtgtttttccgcacgctcggcggcagccgcatttcccatgtcggactttatatcggcaacaaccgcttcatccacgcgccgcgcacggggaaaaatatcgaaatcaccagcctgagccacaaatattggagcggcaaatatgcgttcgcccgccgggtcaagaaaaacgacccgtcacgctttctgaactga

SEQ ID NO: 794 - protein, 222 aa, Neisseria gonorrhoeae
  misc_feature (84)..(84): Xaa can be any naturally occurring amino acid
MDSFFKPAVWAVLWLMFAVRPALADELTNLLSSREQILRQFAEDEQPVLPVNRAPARRAGNADELIGGAMGLNEQPVVRVNRAXARRAGNADKLIGSAMRLLGIAYRYGGTSVSTGFDCSGFMQHIFKRAMGINLPRTSAEQARMGAPVARSELQPGDMVFFRTLGGSRISHVGLYIGNNRFIHAPRTGKNIEITSLSHKYWSGKYAFARRVKKNDPSRFLN

SEQ ID NO: 795 - DNA, 747 bp, Neisseria meningitidis
ttttcaaacccggcagtttgggcggttttgtggctgawgtttgccgtccgccccgcccttgccgacgagttgaccaacctgctcagcagccgcgagcagattctcagacagtttgccgaagacgaacagcccgttttacccatcaaccgagcccccgcccggcgggcgggcaatgccgacgaactcatcggcagcgcgatggggcttaacgaacagcccgttttacccgtcaaccgagtccccgcccggcgggcgggcaatgccgacgaactcatcggcaacgcgatggggcttaacgaacagcccgttttacccgtcaaccgagcccccgcccggcgggcgggcaatgccgacgaactcatcggcaacgcgatgggacttttgggtattgcctaccgctacggcggcacatcggtttctaccggttttgactgcagcggcttcatgcagcacatcttcaaacgcgccatgggcatcaacctgccgcgcacgtcggcagaacaggcacggatgggtacgccggttgcccgaagcgaattgcagcccggagatatggtgtttttccgcacgctcggcggcagccgcatttcccatgtcggactttatatcggcaacaaccgcttcatccacgcgccgcgcacggggaaaaatatcgaaatcaccagcctgagccacaaatattggagcggcaaatacgcgttcgcccgccgggtcaagaaaaacgacccgtcccgctttctgaactga

SEQ ID NO: 796 - protein, 248 aa, Neisseria meningitidis
  misc_feature (13)..(13): Xaa can be any naturally occurring amino acid
FSNPAVWAVLWLXFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 797 - DNA, 843 bp, Neisseria meningitidis
  misc_feature (160)..(160): n is a, c, g, or t
  misc_feature (247)..(247): n is a, c, g, or t
  misc_feature (277)..(277): n is a, c, g, or t
  misc_feature (656)..(656): n is a, c, g, or t
atggattcttttttcaaaccggcagtttgggcggttttgtggctgatgtttgccgtccgccccgcccttgccgacgagttgaccaacctgctcagcagccgcgagcagattctcagacagtttgccgaagacgaacagcccgttttacccatcaaccgancccccgcccggcgggcgggcaatgccgacgaactcatcggcagcgcgatggggcttaacgaacagcccgttttacccgtcaaccgantccccgcccggcgggcgggcaatgccgacnaactcatcggcaacgcgatggggcttaacgaacagcccgttttacccgtcaaccgagtccccgcccggcgggcgggcaatgccgacgaactcatcggcaacgcgatggggcttaacgaacagcccgttttacccgtcaaccgagcccccgcccggcgggcgggcaatgccgacgaactcatcggcaacgcgatgggacttttgggtattgcctaccgctacggcggcacatcgatttctaccggttttgactgcagcggcttcatgcagcacatcttcaaacgcgccatgggcatcaacctgccgcgcacgtcggcagaacaggcgcggatgggtacgccggttgcccgaagcgaattgcagcccggggatatggtgtntttccgcacgctcggcggcagccgcatttcccatgtcggactttatatcggcaacaaccgcttcatccacgcgccgcgcacggggaaaaatatcgaaatcaccagcctgagccacaaatattggagcggcaaatacgcgttcgcccgccgggtcaagaaaaacgacccgtcccgctttctgaactga

SEQ ID NO: 798 - protein, 280 aa, Neisseria meningitidis
  misc_feature (54)..(54): Xaa can be any naturally occurring amino acid
  misc_feature (83)..(83): Xaa can be any naturally occurring amino acid
  misc_feature (93)..(93): Xaa can be any naturally occurring amino acid
  misc_feature (219)..(219): Xaa can be any naturally occurring amino acid
MDSFFKPAVWAVLWLMFAVRPALADELTNLLSSREQILRQFAEDEQPVLPINRXPARRAGNADELIGSAMGLNEQPVLPVNRXPARRAGNADXLIGNAMGLNEQPVLPVNRVPARRAGNADELIGNAMGLNEQPVLPVNRAPARRAGNADELIGNAMGLLGIAYRYGGTSISTGFDCSGFMQHIFKRAMGINLPRTSAEQARMGTPVARSELQPGDMVXFRTLGGSRISHVGLYIGNNRFIHAPRTGKNIEITSLSHKYWSGKYAFARRVKKNDPSRFLN

SEQ ID NO: 799 - DNA, 669 bp, Neisseria gonorrhoeae; identical to SEQ ID NO: 793
  misc_feature (250)..(250): n is a, c, g, or t

SEQ ID NO: 800 - protein, 222 aa, Neisseria gonorrhoeae; identical to SEQ ID NO: 794
  misc_feature (84)..(84): Xaa can be any naturally occurring amino acid

SEQ ID NO: 801 - DNA, 756 bp, Neisseria meningitidis
atggattcttttttcaaaccggcagtttgggcggttttgtggctgatgtttgccgtccgccccgcccttgccgacgagttgaccaacytgctcagcagccgcgagcagattctcagacagtttgccgaagacgaacagcccgttttacccatcaaccgagcccccgcccggcgggcgggcaatgccgacgaactcatcggcagcgcgatggggcttaacgaacagcccgttttacccgtcaaccgagtccccgcccggcgggcgggcaatgccgacgaactcatcggcaacgcgatggggcttaacgaacagcccgttttacccgtcaaccgagcccccgcccggcgggcgggcaatgccgacgaactcatcggcaacgcgatgggacttttgggtattgcctaccgctacggcggcacatcggtttctaccggttttgactgcagcggcttcatgcagcacatcttcaaacgcgccatgggcatcaacctgccgcgcacgtcggcagaacaggcacggatgggtacgccggttgcccgaagcgaattgcagcccggagatatggtgtttttccgcacgctcggcggcagccgcatttcccatgtcggactttatatcggcaacaaccgcttcatccacgcgccgcgcacggggaaaaatatcgaaatcaccagcctgagccacaaatattggagcggcaaatacgcgttcgcccgccgggtcaagaaaaacgacccgtcccgctttctgaactga

SEQ ID NO: 802 - protein, 251 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 803 - DNA, 843 bp, Neisseria meningitidis; identical to SEQ ID NO: 797
  misc_feature (160)..(160): n is a, c, g, or t
  misc_feature (247)..(247): n is a, c, g, or t
  misc_feature (277)..(277): n is a, c, g, or t
  misc_feature (656)..(656): n is a, c, g, or t

SEQ ID NO: 804 - protein, 280 aa, Neisseria meningitidis; identical to SEQ ID NO: 798
  misc_feature (54)..(54): Xaa can be any naturally occurring amino acid
  misc_feature (83)..(83): Xaa can be any naturally occurring amino acid
  misc_feature (93)..(93): Xaa can be any naturally occurring amino acid
  misc_feature (219)..(219): Xaa can be any naturally occurring amino acid

SEQ ID NO: 805 - DNA, 597 bp, Neisseria gonorrhoeae
atgagcgaaatcctcaggcagcccagcgttctgcttttcctcacgcttgccgtgtacgcgcttgcgattatcgtgcgcacgcgcacgggcaatatcttctgcaaccccgtactcgtcagcactatcgtgctgattgcctacctgaaaatcctcggtatcgattatgcggtgtaccacaacgccgcgcaattcattgattttcggctgaaacccgccgtcgtcgtgcttgccgtgccgctctaccaaaaccgccgtaaaatcttcaaccagtggctgcccgtcatcgtttcgcagcttgcgggcagcgttacgggcattgttacggggatgtattttgccgcttggctcgggccggatacccaattctccttcccgcctcgtcttcaatatctgttatttacaccctctggaatcccaattcacaccctgtatgcgcgggttctcccgccatttctgttgcctccgcctctcctgccgcgcctcggcccgcatacattgcgccggttcacaatacttccaaaaaaactacggccgtttaagcccctcctcccagttgtggtcctttctcctccgggcctcgcccctcccctcttataa

SEQ ID NO: 806 - protein, 198 aa, Neisseria gonorrhoeae
MSEILRQPSVLLFLTLAVYALAIIVRTRTGNIFCNPVLVSTIVLIAYLKILGIDYAVYHNAAQFIDFRLKPAVVVLAVPLYQNRRKIFNQWLPVIVSQLAGSVTGIVTGMYFAAWLGPDTQFSFPPRLQYLLFTPSGIPIHTLYARVLPPFLLPPPLLPRLGPHTLRRFTILPKKLRPFKPLLPVVVLSPPGLAPPLL

SEQ ID NO: 807 - DNA, 693 bp, Neisseria meningitidis
atgaacgaaatcctcaggcagcccagcgttctgcttttcctcacgcttgccgtgtacgcgcttgcgattatcgtgcgcacgcgcacgggcaatatcttctgcaaccccgtactcgtcagcactatcgtgctgattgcctacctgaaaatcctcggtatcgattatgcggtgtaccacaacgccgcgcaattcattgatttttggctgaaacccgccgtcgtcgtgcttgccgtgccgctctaccaaaaccgccgtaaaatcttcaaccagtggctgcccgtcatcgtttcacagcttgcgggcagcgttacgggcattgttacagggatgtattttgccaaatggctgggcgcggaacgcgaagtcgtcctctcgctcgcgtccaaatctgttaccaaccccatcgctattgaaatcacccgctccatcggcggcattcccgccattaccgccgccaccgtcatcattgccggtctggtcggacagattgccggttacaaaatgctgaagaacacggtcgtcatgccctcgtccgtgggtatgtcgctcggcacggcttcgcacgcgatggggattgccgcctcgctcgaacgcagccgccgtatggcggcatacgcggggctggggctgacgttcaacggcgtactgaccgcgctgattgcgccgctgctcatccccgttttgggattttga

SEQ ID NO: 808 - protein, 230 aa, Neisseria meningitidis
MNEILRQPSVLLFLTLAVYALAIIVRTRTGNIFCNPVLVSTIVLIAYLKILGIDYAVYHNAAQFIDFWLKPAVVVLAVPLYQNRRKIFNQWLPVIVSQLAGSVTGIVTGMYFAKWLGAEREVVLSLASKSVTNPIAIEITRSIGGIPAITAATVIIAGLVGQIAGYKMLKNTVVMPSSVGMSLGTASHAMGIAASLERSRRMAAYAGLGLTFNGVLTALIAPLLIPVLGF

SEQ ID NO: 809 - DNA, 693 bp, Neisseria meningitidis
atgaacgaaatcctcaggcagccgagcatcctgcttttcctcacgcttgccgtgtacgcgcttgcgattatcgtgcgcacgcgcacgggtaatatcttctgcaaccccgtactcgtcagcactatcgtgctgattgcctacctgaaaatcctcggtatcgattatgcggtgtaccacaacgccgcgcagtttatcgatttctggctcaagcccgccgtcgtcgtgcttgccgtgccgctctaccaaaaccgccgtaaaatcttcaaccaatggctgcccgtcatcgtttcgcagcttgcgggcagcgttacgggcattgttacggggatgtattttgccaaatggctgggcgcggaacgcgaagtcgtcctctcgctcgcgtccaaatctgttaccaatcctatcgccatcgaaatcacccgctccatcggcggcattcccgccattaccgccgccaccgtcatcattgccggcctggtcggacagattgccggttacaaaatgttgaaaaacacggtcgttatgccctcatctgtcggaatgtcgctcggcacggcttcgcacgcgatgggcattgccgcctcgctcgaacgcagccgccgcatggcggcatacgcggggctggggctgacgttcaacggcgtactgaccgcgctgattgcgccgctgcttatccccgttttgggattttga

SEQ ID NO: 810 - protein, 230 aa, Neisseria meningitidis
MNEILRQPSILLFLTLAVYALAIIVRTRTGNIFCNPVLVSTIVLIAYLKILGIDYAVYHNAAQFIDFWLKPAVVVLAVPLYQNRRKIFNQWLPVIVSQLAGSVTGIVTGMYFAKWLGAEREVVLSLASKSVTNPIAIEITRSIGGIPAITAATVIIAGLVGQIAGYKMLKNTVVMPSSVGMSLGTASHAMGIAASLERSRRMAAYAGLGLTFNGVLTALIAPLLIPVLGF

SEQ ID NO: 811 - DNA, 345 bp, Neisseria gonorrhoeae
atgaacatcatccgcgcgctcctcatcatcctcggctgcctcgccgccggcgaaaccgccgttttcctagcaggcatcaaactgcccggcagcatcgtcggcatgggcgtgctgtttgcgcttttgcaggcgggttggctcaaaacgtcttggctgcaacagcttaccgacgcgctgatggcaaacctgacgctgttcctcgtgccgccctgcgtggcggtcatcagctatttggatttgattgccgacgattggttttcgatactggtttccgcctccgccagcactttgtgcgtactgctggttacgggcaaggttcaccgctggatacggagcattatctga

SEQ ID NO: 812 - protein, 114 aa, Neisseria gonorrhoeae
MNIIRALLIILGCLAAGETAVFLAGIKLPGSIVGMGVLFALLQAGWLKTSWLQQLTDALMANLTLFLVPPCVAVISYLDLIADDWFSILVSASASTLCVLLVTGKVHRWIRSII

SEQ ID NO: 813 - DNA, 203 bp, Neisseria meningitidis
acgtcttkgctgcaacagcttaccgacgcgctgatgtcgaacctgacgctgttcctcgtgccgcctgcgtggcggtcatcagctatttggatttgattgccgacgattggttttcgatactggtttccgcctccgccagcactttgtgcgtactgctggttacgggcaaagtccaccggtggatacggggtattatccgatga

SEQ ID NO: 814 - protein, 67 aa, Neisseria meningitidis
  misc_feature (3)..(3): Xaa can be any naturally occurring amino acid
TSXLQQLTDALMSNLTLFLVPPCVAVISYLDLIADDWFSILVSASASTLCVLLVTGKVHRWIRGIIR

SEQ ID NO: 815 - DNA, 345 bp, Neisseria meningitidis
atgaacatcatccgcgcgctcctcatcatcctcggctgcctcgccaccggcgaaaccgccgttttcctagcaggcatcaaactgcccggcagcatcgtcggcatgggcgtactgtttgcgcttttgcaggcgggttgggtcaaaacgtcttggctgcaacagcttaccgacgcgctgatggcgaatctgacgttgtttctcgtgccgccctgcgtggcggtcatcagctatttggatttgattgccgacgattggttttcgatactggtttccgcctccgccagcactttgtgcgtactgctggttacaggcaaggttcaccgctggatacggagcattatctga

SEQ ID NO: 816 - protein, 114 aa, Neisseria meningitidis
MNIIRALLIILGCLATGETAVFLAGIKLPGSIVGMGVLFALLQAGWVKTSWLQQLTDALMANLTLFLVPPCVAVISYLDLIADDWFSILVSASASTLCVLLVTGKVHRWIRSII

SEQ ID NO: 817 - DNA, 324 bp, Neisseria meningitidis
atgaaaaaattattgattgccgcaatgatggcggctgccttggcagcttgttcgcaagaagccaaacaggaggttaaggaagcggttcaagccgttgagtccgatgttaaagacactgcggcttctgccgccgagtctgccgcttctgccgtcgaagaagcgaaagaccaagtcaaagatgctgcggctgatgcaaaggcaagtgccgaggaagctgtaactgaagccaaagaagctgtaactgaagcagctaaagatactttgaacaaagctgccgacgcgactcaggaagcggcagacaaaatgaaagatgccgccaaataa

SEQ ID NO: 818 - protein, 107 aa, Neisseria meningitidis
MKKLLIAAMMAAALAACSQEAKQEVKEAVQAVESDVKDTAASAAESAASAVEEAKDQVKDAAADAKASAEEAVTEAKEAVTEAAKDTLNKAADATQEAADKMKDAAK

SEQ ID NO: 819 - DNA, 324 bp, Neisseria meningitidis; identical to SEQ ID NO: 817

SEQ ID NO: 820 - protein, 107 aa, Neisseria meningitidis; identical to SEQ ID NO: 818

SEQ ID NO: 821 - DNA, 591 bp, Neisseria gonorrhoeae
atggctgccgtatcgggcggcggtgcggtcttcctgataatgcttccacatattgcccgcgttcagcgtcagccgccagcgttcgcccaagcgtcgggagaaatcggcattgaagccgccggcgaaattgtatcggctgccgcccaagaggttttgcccgacaaacggcacggtgccgaacgagcgcgttaccgaacggttttgatggccgaacgacaggcgcaggttctgttcgctgaaatctttgttatcccaataatgcacgccgcggctgatgccgccgtagaggaaatgatgcccgcccgcattgatttcgcgcgacacgcccaagccgtagcgcaaaccgtgtgccttttgcggcaggctgtcggcggttttcgtccagcttctgcccgcaaattcaatcgttttttcggacgaagcgttgtttatagcggattaacaaaaatcaggacaaggcggcgggccgcaggcagtacggatggtacggaaccggttcgcccggtgcttggacgccttagggaaccgttccctttgagccggggcggggcaacccgtaccggtttttgttcatccgccatattgtgttga

SEQ ID NO: 822 - protein, 196 aa, Neisseria gonorrhoeae
MAAVSGGGAVFLIMLPHIARVQRQPPAFAQASGEIGIEAAGEIVSAAAQEVLPDKRHGAERARYRTVLMAERQAQVLFAEIFVIPIMHAAADAAVEEMMPARIDFARHAQAVAQTVCLLRQAVGGFRPASARKFNRFFGRSVVYSGLTKIRTRRRAAGSTDGTEPVRPVLGRLREPFPLSRGGATRTGFCSSAILC

SEQ ID NO: 823 - DNA, 482 bp, Neisseria meningitidis
gctcaagcgttgggagaaatcggcattgaagccgccgacgaaattgtatcggctgccgcctaagaggttttgctcgacaaacggcacgatgccgaacgagcgcgttaccgaacggtttttatagccgaacgacaggcgcaggctctgttcgctgaaatctttgttatcccaataatgcacgccgccgccgctgatgccgccgtagaggaaatgatgcctgcccgcattgatttcgcgcgacacgcctaagccctagcgcaaaccgtgtgccttttgcggcaggctgtcggcggttttcgtccagcttctgcccgcaaattcaatcgttttttcggacgaagcgttgtttatagcggattaacaaaaatcaggacaaggcaacgaagccgcagacagtacaaatagtacggaaccgattcacttggtgcttcagcaccttagagaatcgttctcttttttgttcatccgctatattgtgttga

SEQ ID NO: 824 - protein, 160 aa, Neisseria meningitidis
  misc_feature (21)..(21): Xaa can be any naturally occurring amino acid
  misc_feature (83)..(83): Xaa can be any naturally occurring amino acid
AQALGEIGIEAADEIVSAAAXEVLLDKRHDAERARYRTVFIAERQAQALFAEIFVIPIMHAAAADAAVEEMMPARIDFARHAXALAQTVCLLRQAVGGFRPASARKFNRFFGRSVVYSGLTKIRTRQRSADSTNSTEPIHLVLQHLRESRSLFCSSAILC

SEQ ID NO: 825 - DNA, 583 bp, Neisseria meningitidis
atggctgtcgtatcgggcggcggtgcggtcttcctgataacgcttccacatattgcccacgttcagcgtcagccgccagttcgctcaagcgtcgggagaaatcggcattgaagccgccgacgaaattgtatcggctgccgcctaagaggttttgctcgataaacggcacgatgccgaatgagcgcgttactgaacggtttttatagccgagcgacaggcgcaggctctgttcgctgaaatctttgttatcctaatagtgcacgccgccgccgctgatgtctccgtagaggaaatgatgcccgcccgcattgatttcgcgcgacacgcccaagccgtagcgcaaaccgtgtgccttttgcggcaggctgtcggcggttttcgtccagcttctgcctgcaaattcaatcgttttttcggacgaagcgttgtttatagcggattaacaaaaatcaggacaaggcgacgaagcgcagacagtacagatagtacggaaccgattcacttggtgcttcagcaccttagagaatcgtctctttgagctaaggcgaggcaacgccgtactggtttttgttcatccactata

SEQ ID NO: 826 - protein, 191 aa, Neisseria meningitidis
  misc_feature (27)..(27): Xaa can be any naturally occurring amino acid
MAVVSGGGAVFLITLPHIAHVQRQPPXFAQASGEIGIEAADEIVSAAAEVLLDKRHDAEARYTVFIAERQAQALFAEIFVILIVHAAAADVSVEEMMPARIDFARHAQAVAQTVCLLRQAVGGFRPASACKFNRFFGRSVVYSGLTKIRTRRRSADSTDSTEPIHLVLQHLRESSLAKARQRRTGFCSSTI

SEQ ID NO: 827 - DNA, 1173 bp, Neisseria gonorrhoeae
atgttccattccatcgaaaaatacagaacacccgcccaagtcttattaggcctgattgcattaacttttgtcggcttcggcgtcagcacggtttcccatccgggcgccgactacatcgtccaagtgggcgacgaaaaaatcagcgagcactcaatcaacaacgccatgcagaacgagcaggcggacggcggcagcccttggcgcgacgcggtgttccaatccctgctgcaacgcgcctacctgaaacagggcgcgaagctgatgggcatttcggtttcttccgaacaaatcaagcagatgattgtggacgatcccaatttccacgacgcaaacggcaaattcagtcacgcgcttttgagtcaatacctgtcgcaacgccatatgtctgaagaccagtttgtcgaagaaatccgcgatcagtttgccttgcagaatttggtaagcctcgtccaaaacggcgtattggtcggcgacgcgcaggcggaacagctgatcaggctgacgcaggtcaaccgcaccatccgttcgcacactttcaaccccgacgagttcatcgcccaagtcaaagcgtctgaagccgatttgcagaaattttataatgcgaacaaaaaagactatctgctgccgcaggcggtcaaattggaatatgtcgccttgaatctgaaggattttgcagacaagcagaccgtcagtgaaacggaagtgaaaaatgcgtttgaagagcgcgtggcgcgtttgccggcacatgaagccaaaccttctttcgagcaggaaaaagccgccgtcgaaaacgaattgaaaatgaaaaaggcggttgccgacttcaacaaggcaaaagaaaagctgggcgacgatgcgttcaatcatccctcctcgcttgccgaagccgccaaaaacagcggtttgaaagtggaaacccaagaaacttggctgagcaggcaggacgcacaaatgtccggcatgcccgaaaacctaatcaatgccgtattcagcgacgacgtattgaagaaaaaacacaattccgaagtgctgaccatcaacagcgaaaccgcgtgggtcgtccgcgccaaagaagtccgcgaagaaaaaaacctactgtttgaagaagccaaagatgcggtgcgtcaggcctatatccgtaccgaagccgccaaacttttgaaaacaatgtaa

SEQ ID NO: 828 - protein, 390 aa, Neisseria gonorrhoeae
MFHSIEKYRTPAQVLLGLIALTFVGFGVSTVSHPGADYIVQVGDEKISEHSINNAMQNEQADGGSPWRDAVFQSLLQRAYLKQGAKLMGISVSSEQIKQMIVDDPNFHDANGKFSHALLSQYLSQRHMSEDQFVEEIRDQFALQNLVSLVQNGVLVGDAQAEQLIRLTQVNRTIRSHTFNPDEFIAQVKASEADLQKFYNANKKDYLLPQAVKLEYVALNLKDFADKQTVSETEVKNAFEERVARLPAHEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKNLLFEEAKDAVRQAYIRTEAAKLLKTM

SEQ ID NO: 829 - DNA, 1156 bp, Neisseria meningitidis
atgttccattccatcgaaaaatacagaacgcccgcccaagtccttttgggcctgattgcattaaccttcgtcggcttcggggtcagcacggtatcccatccgggtgccgactacatcgtccaagtgggcgacgaaaaaatcagcgaccactccatcaacaacgccatacagaacgaacaggcggacggcggcggcccttcgccgacgcggtgttccaatccctgctgcaacgcgcctacctgaaacagggcgcgaagctgatgggcatttcggtttcttccgaacaaatcaagcaaattatcgtggacgatcccaatttccacgacgcaaacggcaaattcgaccacgcgcttttaaaccgctacctttcccaacgccatatgtctgaagaccagtttgtcgaagaaatccgcgatcagtttgccttgcagaatttggtaaacctcgtccaaaacggcgtattggtcggcgacgcgcaggcggaacagctgatcaggctgacacaggtcaaccgcaccatccgttcgcacactttcaaccccgacgagttcatcgcccaagtcaaagtgtctgaagccgatttgcagaaattttataatgcgaacaaaaaagactatctgctgccgcaggcggtcaaattggaatatgtcgccttgaatctgaaggattttgcagacaagcagaccgtcagtgaaacggaagtgaaaaatgcatttgaagagcgcgtggcgcgtttgccggcaaatgaagccaaaccttctttcgagcaggaaaaagccgccgtcgaaaacgaattgaaaatgaaaaaggcggttgccgacttcaacaaggcaaaagaaaaattgggcgacgatgcgtcaaccatccttcytcgcttgccgaagccgccaaaaacagcggtttgaaagtcgaaacccaagaaacttggctgagtaggcaggacgcgcaaatgtccggtatgcccgaaaacctgatcaatgccgtattcagcgacgacgtattgaagaaaaaacacaattccgaagtgctgaccatcaacagcgaaaccgcgtgggtcgtccgcgccaaagaagtccgcgaagagaaaaccctgccgtttgccgaagccaaagacgcggtacgtcaggcttatatccgtaccgaagccgccaaactt

SEQ ID NO: 830 - protein, 386 aa, Neisseria meningitidis
MFHSIEKYRTPAQVLLGLIALTFVGFGVSTVSHPGADYIVQVGDEKISDHSINNAIQNEQADGGGPSPDAVFQSLLQRAYLKQGAKLMGISVSSEQIKQIIVDDPNFHDANGKFDHALLNRYLSQRHMSEDQFVEEIRDQFALQNLVNLVQNGVLVGDAQAEQLIRLTQVNRTIRSHTFNPDEFIAQVKVSEADLQKFYNANKKDYLLPQAVKLEYVALNLKDFADKQTVSETEVKNAFEERVARLPANEAKPSFEQEKAAVENELKMKKAVADFNKAKEKLGDDAVNHPSSLAEAAKNSGLKVETQETWLSRQDAQMSGMPENLINAVFSDDVLKKKHNSEVLTINSETAWVVRAKEVREEKTLPFAEAKDAVRQAYIRTEAAKL

SEQ ID NO: 831 - DNA, 1158 bp, Neisseria meningitidis
atgttccattccatcgaaaaatacagaacgcccgcccaagtccttttgggcctgattgcattaaccttcgtcggcttcggggtcagcacggtatcccatccgggtgccgactacatcgtccaagtgggcgacgaaaaaatcagcgaccactccatcaacaacgccatacagaacgaacaggcggacggcggcggcccttcgcgcgacgcggtgttccaatccctgctacaacgcgcctacctgaaacagggcgcgaagctgatgggcatttcggtttcttccgaacaaatcaagcagattatcgtggacgatcccaatttccacgacgcaaacggcaaattcgaccacgcgcttttaaaccgctacctttcccaacgtcatatgtctgaagaccagtttgtcgaagaaatccgcgatcagtttgccttgcagaatttggtaaacctcgtccaaaacggcgtattggtcggcgacgcgcaggcggaacagctgatcaggctgacgcaggtcaaccgcaccatccgttcgcacactttcaaccccgacgaattcatcgcccaagtcaaagtgtctgaagccgatttgcagaagttttataacgcaaacaaaaaagactacctgcttcccaaagcggtcaaattggaatatgtcgccttgaatctgaaagactttgcagacaaacagaccgtcagcgaaacagaagtgaaaaatgcgtttgaagagcgcgtggcgcgtttgccggcaaatgaagccaaaccttctttcgagcaggaaaaagccgccgtcgaaaacgaattgaaaatgaaaaaggcggttgccgacttcaataaggcaaaagaaaagctgggcgatgacgcgttcaaccatccttcctcgcttgccgaagccgccaaaaacagcggtttgaaagtcgaaacccaagaaacttggctgagcaggcaggatgcgcaaatgtccggtatgcccgaaaacctgatcaatgccgtattcagcgacgacgtattgaagaaaaaacacaattccgaagtgctgaccatcaacagcgaaaccgcgtgggtcgtccgcgccaaagaagtccgcgaagagaaaaccctgccgtttgccgaagccaaagacgcggtacgtcaggcttatatccgtaccgaagccgccaaactt

SEQ ID NO: 832 - protein, 386 aa, Neisseria meningitidis
MFHSIEKYRTPAQVLLGLIALTFVGFGVSTVSHPGADYIVQVGDEKISDHSINNAIQNEQADGGGPSRDAVFQSLLQRAYLKQGAKLMGISVSSEQIKQIIVDDPNFHDANGKFDHALLNRYLSQRHMSEDQFVEEIRDQFALQNLVNLVQNGVLVGDAQAEQLIRLTQVNRTIRSHTFNPDEFIAQVKVSEADLQKFYNANKKDYLLPKAVKLEYVALNLKDFADKQTVSETEVKNAFEERVARLPANEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKTLPFAEAKDAVRQAYIRTEAAKL

SEQ ID NO: 833 - DNA, 1539 bp, Neisseria gonorrhoeae
atgttccattccatcgaaaaatacagaacacccgcccaagtcttattaggcctgattgcattaacttttgtcggcttcggcgtcagcacggtttcccatccgggcgccgactacatcgtccaagtgggcgacgaaaaaatcagcgagcactcaatcaacaacgccatgcagaacgagcaggcggacggcggcagcccttggcgcgacgcggtgttccaatccctgctgcaacgcgcctacctgaaacagggcgcgaagctgatgggcatttcggtttcttccgaacaaatcaagcagatgattgtggacgatcccaatttccacgacgcaaacggcaaattcagtcacgcgcttttgagtcaatacctgtcgcaacgccatatgtctgaagaccagtttgtcgaagaaatccgcgatcagtttgccttgcagaatttggtaagcctcgtccaaaacggcgtattggtcggcgacgcgcaggcggaacagctgatcaggctgacgcaggtcaaccgcaccatccgttcgcacactttcaaccccgacgagttcatcgcccaagtcaaagcgtctgaagccgatttgcagaaattttataatgcgaacaaaaaagactatctgctgccgcaggcggtcaaattggaatatgtcgccttgaatctgaaggattttgcagacaagcagaccgtcagtgaaacggaagtgaaaaatgcgtttgaagagcgcgtggcgcgtttgccggcacatgaagccaaaccttctttcgagcaggaaaaagccgccgtcgaaaacgaattgaaaatgaaaaaggcggttgccgacttcaacaaggcaaaagaaaagctgggcgacgatgcgttcaatcatccctcctcgcttgccgaagccgccaaaaacagcggtttgaaagtggaaacccaagaaacttggctgagcaggcaggacgcacaaatgtccggcatgcccgaaaacctaatcaatgccgtattcagcgacgacgtattgaagaaaaaacacaattccgaagtgctgaccatcaacagcgaaaccgcgtgggtcgtccgcgccaaagaagtccgcgaagaaaaaaacctactgtttgaagaagccaaagatgcggtgcgtcaggcctatatccgtaccgaagccgccaaacttgccgaaaacaaggcaaaagaagtgcttacccaactgaacggcggcaaggcagttgacgtgaaatggtcggaagtgtccgttttgggcgcgcagcaggcaaggcagtccatgccgcccgaggcttatgcggaactgctgaaagcaaaaccggcaaacggcaaacccgcctatgtcagactgaccggtctgccggcacccgtgattgtcgaggcgcaggcagtcacgcctccggaggatattgccgcacagcttcctcctgcgaaacaggctttggcgcaacagcagtctgccaatactttcgacctgctgatccgctatttcaacggaaaaatcaaacagactaaaggagcacaatcggttgacaacggcgatggtcagtaa

SEQ ID NO: 834 - protein, 512 aa, Neisseria gonorrhoeae
MFHSIEKYRTPAQVLLGLIALTFVGFGVSTVSHPGADYIVQVGDEKISEHSINNAMQNEQADGGSPWRDAVFQSLLQRAYLKQGAKLMGISVSSEQIKQMIVDDPNFHDANGKFSHALLSQYLSQRHMSEDQFVEEIRDQFALQNLVSLVQNGVLVGDAQAEQLIRLTQVNRTIRSHTFNPDEFIAQVKASEADLQKFYNANKKDYLLPQAVKLEYVALNLKDFADKQTVSETEVKNAFEERVARLPAHEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKNLLFEEAKDAVRQAYIRTEAAKLAENKAKEVLTQLNGGKAVDVKWSEVSVLGAQQARQSMPPEAYAELLKAKPANGKPAYVRLTGLPAPVIVEAQAVTPPEDIAAQLPPAKQALAQQQSANTFDLLIRYFNGKIKQTKGAQSVDNGDGQ

SEQ ID NO: 835 - DNA, 1539 bp, Neisseria meningitidis
atgttccattccatcgaaaaatacagaacgcccgcccaagtccttttgggcctgattgcattaaccttcgtcggcttcggggtcagcacggtatcccatccgggtgccgactacatcgtccaagtgggcgacgaaaaaatcagcgaccactccatcaacaacgccatacagaacgaacaggcggacggcggcggcccttcgcgcgacgcggtgttccaatccctgctgcaacgcgcctacctgaaacagggcgcgaagctgatgggcatttcggtttcttccgaacaaatcaagcaaattatcgtggacgatcccaatttccacgacgcaaacggcaaattcgaccacgcgcttttaaaccgctacctttcccaacgccatatgtctgaagaccagtttgtcgaagaaatccgcgatcagtttgccttgcagaatttggtaaacctcgtccaaaacggcgtattggtcggcgacgcgcaggcggaacagctgatcaggctgacacaggtcaaccgcaccatccgttcgcacactttcaaccccgacgagttcatcgcccaagtcaaagtgtctgaagccgatttgcagaaattttataatgcgaacaaaaaagactatctgctgccgcaggcggtcaaattggaatatgtcgccttgaatctgaaggattttgcagacaagcagaccgtcagtgaaacggaagtgaaaaatgcatttgaagagcgcgtggcgcgtttgccggcaaatgaagccaaaccttctttcgagcaggaaaaagccgccgtcgaaaacgaattgaaaatgaaaaaggcggttgccgacttcaacaaggcaaaagaaaaattgggcgacgatgcgttcaaccatccttcctcgcttgccgaagccgccaaaaacagcggtttgaaagtcgaaacccaagaaacttggctgagtaggcaggacgcgcaaatgtccggtatgcccgaaaacctgatcaatgccgtattcagcgacgacgtattgaagaaaaaacacaattccgaagtgctgaccatcaacagcgaaaccgcgtgggtcgtccgcgccaaagaagtccgcgaagagaaaaccctgccgtttgccgaagccaaagacgcggtacgtcaggcttatatccgtaccgaagccgccaaacttgccgaaaacaaggcaaaagacgtgcttacccaactgaacggcggcaaggctgttgacgtgaaatggtcggaagtgtccgttttgggcgcacagcaggcaaggcagtccatgccgcccgaggcttatgcggaactgctgaaagcaaaaccggcaaacggcaaacccgcctacgtcaggctgatcggtctgccggcacccgtgattgtcgaagtacaggctgtaaccccgccggatgatatcgccgcacagcttccgcttgcaaaacaggctttggcgcaacagcagtctgccaatactttcgacttgttgatacgttatttcaacggcaaaatcaaacagaccaaaggagcgcaatcggtcgacaacggcgacggtcagtaa

SEQ ID NO: 836 - protein, 512 aa, Neisseria meningitidis
MFHSIEKYRTPAQVLLGLIALTFVGFGVSTVSHPGADYIVQVGDEKISDHSINNAIQNEQADGGGPSRDAVFQSLLQRAYLKQGAKLMGISVSSEQIKQIIVDDPNFHDANGKFDHALLNRYLSQRHMSEDQFVEEIRDQFALQNLVNLVQNGVLVGDAQAEQLIRLTQVNRTIRSHTFNPDEFIAQVKVSEADLQKFYNANKKDYLLPQAVKLEYVALNLKDFADKQTVSETEVKNAFEERVARLPANEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKTLPFAEAKDAVRQAYIRTEAAKLAENKAKDVLTQLNGGKAVDVKWSEVSVLGAQQARQSMPPEAYAELLKAKPANGKPAYVRLIGLPAPVIVEVQAVTPPDDIAAQLPLAKQALAQQQSANTFDLLIRYFNGKIKQTKGAQSVDNGDGQ

SEQ ID NO: 837 - DNA, 1539 bp, Neisseria meningitidis
atgttccattccatcgaaaaatacagaacgcccgcccaagtccttttgggcctgattgcattaaccttcgtcggcttcggggtcagcacggtatcccatccgggtgccgactacatcgtccaagtgggcgacgaaaaaatcagcgaccactccatcaacaacgccatacagaacgaacaggcggacggcggcggcccttcgcgcgacgcggtgttccaatccctgctacaacgcgcctacctgaaacagggcgcgaagctgatgggcatttcggtttcttccgaacaaatcaagcagattatcgtggacgatcccaatttccacgacgcaaacggcaaattcgaccacgcgcttttaaaccgctacctttcccaacgtcatatgtctgaagaccagtttgtcgaagaaatccgcgatcagtttgccttgcagaatttggtaaacctcgtccaaaacggcgtattggtcggcgacgcgcaggcggaacagctgatcaggctgacgcaggtcaaccgcaccatccgttcgcacactttcaaccccgacgaattcatcgcccaagtcaaagtgtctgaagccgatttgcagaagttttataacgcaaacaaaaaagactacctgcttcccaaagcggtcaaattggaatatgtcgccttgaatctgaaagactttgcagacaaacagaccgtcagcgaaacagaagtgaaaaatgcgtttgaagagcgcgtggcgcgtttgccggcaaatgaagccaaaccttctttcgagcaggaaaaagccgccgtcgaaaacgaattgaaaatgaaaaaggcggttgccgacttcaataaggcaaaagaaaagctgggcgatgacgcgttcaaccatccttcctcgcttgccgaagccgccaaaaacagcggtttgaaagtcgaaacccaagaaacttggctgagcaggcaggatgcgcaaatgtccggtatgcccgaaaacctgatcaatgccgtattcagcgacgacgtattgaagaaaaaacacaattccgaagtgctgaccatcaacagcgaaaccgcgtgggtcgtccgcgccaaagaagtccgcgaagagaaaaccctgccgtttgccgaagccaaagacgcggtacgtcaggcttatatccgtaccgaagccgccaaacttgccgaaaacaaggcaaaagacgtgcttacccaactgaacggcggcaaggctgttgacgtgaaatggtcggaagtgtccgttttgggcgcacagcaggcaaggcagtccatgccgcccgaggcttatgcggaactgctgaaagcaaaaccggcaaacggcaaacccgcctacgtcaggctgatcggtctgccggcacccgtgattgtcgaagtacaggctgtaaccccgccggatgatatcgccgcacagcttccgcttgcaaaacaggctttggcgcaacagcagtctgccaatactttcgacttgttgatacgttatttcaacggcaaaatcaaacagaccaaaggagcgcaatcggtcgacaacggcgacggtcagtaa

SEQ ID NO: 838 - protein, 512 aa, Neisseria meningitidis
MFHSIEKYRTPAQVLLGLIALTFVGFGVSTVSHPGADYIVQVGDEKISDHSINNAIQNEQADGGGPSRDAVFQSLLQRAYLKQGAKLMGISVSSEQIKQIIVDDPNFHDANGKFDHALLNRYLSQRHMSEDQFVEEIRDQFALQNLVNLVQNGVLVGDAQAEQLIRLTQVNRTIRSHTFNPDEFIAQVKVSEADLQKFYNANKKDYLLPKAVKLEYVALNLKDFADKQTVSETEVKNAFEERVARLPANEAKPSFEQEKAAVENELKMKKAVADFNKAKEKLGDDAFNHPSSLAEAAKNSGLKVETQETWLSRQDAQMSGMPENLINAVFSDDVLKKKHNSEVLTINSETAWVVRAKEVREEKTLPFAEAKDAVRQAYIRTEAAKLAENKAKDVLTQLNGGKAVDVKWSEVSVLGAQQARQSMPPEAYAELLKAKPANGKPAYVRLIGLPAPVIVEVQAVTPPDDIAAQLPLAKQALAQQQSANTFDLLIRYFNGKIKQTKGAQSVDNGDGQ

SEQ ID NO: 839 - DNA, 906 bp, Neisseria gonorrhoeae
atgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaggccgtgcggtgtctttaccaaatgcccaaccattcgcccacggaatccatccaatccttattgcccccgccgctcctgcctgcccggcggtacgcccacggcgcttgcggatttttagctttccacaatcctttgcgttccctttccgcctgaatttgagcgtcggcatagtcggcaaaatccgccttatcctgctgttctttagcataacttttataatgccacgccgccccgtcctgcacctgcatcaggttcaaatcggttttgccggcggatacctgcgccacttcgcgctgatagcggtcggtttcaaacacacgtacactgactttcctaccctccgccgccgcgcgcaggttgtcgcgcgaacgtgtaccgtaagcctgtttcatctccggtgcgtcgatatacgccatccgaattttatgtttcgcgccgtcgccgtcgatgacgtgaagggtatcgccgtcatagactttggacaccgtgcctgtgtagctgtggccggatttcgccgatgcccgtcggcgaacgggcgcgtcgaaacccacgtcccctgcagtgccgagtacgtcgagtacggcaaccgccgtccgcaccgcctcactgtcatatcccgtataacccaacgcgcccaaaagcgacagggcgacgggaagccatttcatgatttttttaatctgcatatttttcaaatgccgatgccgtctgaacatctctga

SEQ ID NO: 840 - protein, 301 aa, Neisseria gonorrhoeae
MSKRKSINRPYQKPAELPPLQNNPPFYRKNRRLNFFIAADGGCASPQKCRARGFQTAFAVQGRAVSLPNAQPFAHGIHPILIAPAAPACPAVRPRRLRIFSFPQSFAFPFRLNLSVGIVGKIRLILLFFSITFIMPRRPVLHLHQVQIGFAGGYLRHFALIAVGFKHTYTDFPTLRRRAQVVARTCTVSLFHLRCVDIRHPNFMFRAVAVDDVKGIAVIDFGHRACVAVAGFRRCPSANGRVETHVPCSAEYVEYGNRRPHRLTVISRITQRAQKRQGDGKPFHDFFNLHIFQMPMPSEHL

SEQ ID NO: 841 - DNA, 222 bp, Neisseria meningitidis
atgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaagccgtgcggtgtctttaccaaatgcccaaccattcggc

SEQ ID NO: 842 - protein, 74 aa, Neisseria meningitidis
MSKRKSINRPYQKPAELPPLQNNPPFYRKNRRLNFFIAADGGCASPQKCRARGFQTAFAVQSRAVSLPNAQPFG

SEQ ID NO: 843 - DNA, 903 bp, Neisseria meningitidis
  misc_feature (113)..(113): n is a, c, g, or t
atgtcaaaacgaaaatccataaaccgtccgtatcaaaaaccggcggaactgccgccgttgcaaaataatccgccattttaccgtaaaaaccgccgcctgaacttttttatcgnggcagacggcggttgcgcgtctccgcaaaaatgcagggcgcgcggttttcagacggcatttgccgttcaaagccgtgcggtgtctttaccaaatgcccaaccattcgcccacggcatccatccaatccttattgcccccgccgctcctgcctgcccggcggtacgcccacggcgcttgcggatttttagctttccacaatcctttgcgttccctttccgcctgaatttgagcgtcggcataatcggcaaaatccgccttatcctgctgttctttagcataacttttataatgccacgccgccccgtcctgcacctgcatcaggttcaaatcggttttgccgacagaaacctgcgccacttcgcgctggtagcggtcggtgtcgaacacgcggacgctgactttcctgccttccgccgccgcgcgcaggttgtcgcgcgaacgcgtgccgtaagcctgtttcatctccggcgcgtcgatatacgccatccggattttgtgtttcgcgccgtcgccgtcgataacgtgaagggtgtcgccgtcatagactttggacaccgtgcctgtgtagcggtggccggatttcgccgatgctcggcggcgggcgggcgcgtcggaacccgcgtcccctgccgcgccgagtacgtcgagtacggcaaccgccgtccgcaccgcctcgctgccgtaccccgtataacccaacgcacccaaaagcgacaaggcgacgggaagccatttcatgatttttttaatctgcatatttttcaaatgccgatgccgtctgaacatatc

SEQ ID NO: 844 - protein, 301 aa, Neisseria meningitidis
  misc_feature (38)..(38): Xaa can be any naturally occurring amino acid
MSKRKSINRPYQKPAELPPLQNNPPFYRKNRRLNFFIXADGGCASPQKCRARGFQTAFAVQSRAVSLPNAQPFAHGIHPILIAPAAPACPAVRPRRLRIFSFPQSFAFPFRLNLSVGIIGKIRLILLFFSITFIMPRRPVLHLHQVQIGFADRNLRHFALVAVGVEHADADFPAFRRRAQVVARTRAVSLFHLRRVDIRHPDFVFRAVAVDNVKGVAVIDFGHRACVAVAGFRRCSAAGGRVGTRVPCRAEYVEYGNRRPHRLAAVPRITQRTQKRQGDGKPFHDFFNLHIFQMPMPSEHI

SEQ ID NO: 845 - DNA, 699 bp, Neisseria gonorrhoeae
atgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaggccgtgcggtgtctttaccaaatgcccaaccattcgcccacggaatccatccaatccttattgcccccgccgctcctgcctgcccggcggtacgcccacggcgcttgcggatttttagctttccacaatcctttgcgttccctttccgcctgaatttgagcgtcggcatagtcggcaaaatccgccttatcctgctgttctttagcataacttttataatgccacgccgccccgtcctgcacctgcatcaggttcaaatcggttttgccggcggatacctgcgccacttcgcgctgatagcggtcggtttcaaacacacgtacaatgagtttcgtaccctccgccgccgcgcgcaggttgtcgcgcgaacgtgtaccgtaagcgtgtttcatctccggtgcgtcgatatacgccatccgaattttatgtttcgcgccgtcgccgtcgatgacgtgaagggtatcgccgtcatagactttggacaccgtgcctgcgtagctgtggccggatttcgc

SEQ ID NO: 846 - protein, 233 aa, Neisseria gonorrhoeae
MSKRKSINRPYQKPAELPPLQNNPPFYRKNRRLNFFIAADGGCASPQKCRARGFQTAFAVQGRAVSLPNAQPFAHGIHPILIAPAAPACPAVRPRRLRIFSFPQSFAFPFRLNLSVGIVGKIRLILLFFSITFIMPRRPVLHLHQVQIGFAGGYLRHFALIAVGFKHTYNEFRTLRRRAQVVARTCTVSVFHLRCVDIRHPNFMFRAVAVDDVKGIAVIDFGHRACVAVAGFR

SEQ ID NO: 847 - DNA, 930 bp, Neisseria meningitidis
atgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaagccgtgcggtgtctttaccaaatgcccaaccattcgcccacggcatccatccaatccttattgcccccgccgctcctgcctgctcggcggtacgcccacggcgcttgcggatttttagctttccacaatcctttgcgttccctttccgcctgaatttgagcgtcggcataatcggcaaaatccgccttatcctgctgttctttagcataacttttataatgccacgccgccccgtcctgcacctgcatcaggttcaaatcggttttgccgacagaaacctgcgccacttcgcgctggtagcggtcggtatcgaacacgcgcacgctgactttcctgccttccgccgccgcgcgcaggttgtcgcgcgaacgcgtgccgtaagcctgtttcatctccggcgcgtcgatatacgccatccggattttgtgtttcgcgccgtcgccgtcgataacgtgaagggtgtcgccgtcatagactttggacaccgtgcctgtgtagcggtggccggatttcgccgatgctcggcggcgggcgggcgcgtcggaacccgcgtcccctgccgcgccgagtacgtcgagtacggcaaccgccgtccgcaccgcctcgctgccgtaccccgtataacccaacgcacccaaaagcgacagggcgacgggaagccatttcatgatttttttaatctgcatatttttcaaatgccgatgccgtctgaacatatcggaatcggatttcagacggcatcttaa

SEQ ID NO: 848 - protein, 309 aa, Neisseria meningitidis
MSKRKSINRPYQKPAELPPLQNNPPFYRKNRRLNFFIAADGGCASPQKCRARGFQTAFAVQSRAVSLPNAQPFAHGIHPILIAPAAPACSAVRPRRLRIFSFPQSFAFPFRLNLSVGIIGKIRLILLFFSITFIMPRRPVLHLHQVQIGFADRNLRHFALVAVGIEHAHADFPAFRRRAQVVARTRAVSLFHLRRVDIRHPDFVFRAVAVDNVKGVAVIDFGHRACVAVAGFRRCSAAGGRVGTRVPCRAEYVEYGNRRPHRLAAVPRITQRTQKRQGDGKPFHDFFNLHIFQMPMPSEHIGIGFQTAS

SEQ ID NO: 849 - DNA, 930 bp, Neisseria meningitidis
atgtcaaaacgaaaatccataaaccgtccgtatcaaaaaccggcggaactgccgccgttgcaaaataatccgccattttaccgtaaaaaccgccgcctgaacttttttatcgcggcagacggcggttgcgcgtctccgcaaaaatgcagggcgcgcggttttcagacggcatttgccgttcaaagccgtgcggtgtctttaccaaatgcccaaccattcgcccacggcatccatccaatccttattgcccccgccgctcctgcctgcccggcggtacgcccacggcgcttgcggatttttagctttccacaatcctttgcgttccctttccgcctgaatttgagcgtcggcataatcggcaaaatccgccttatcctgctgttctttagcataacttttataatgccacgccgccccgtcctgcacctgcatcaggttcaaatcggttttgccgacagaaacctgcgccacttcgcgctggtagcggtcggtgtcgaacacgcggacgctgactttcctgccttccgccgccgcgcgcaggttgtcgcgcgaacgcgtgccgtaagcctgtttcatctccggcgcgtcgatatacgccatccggattttgtgtttcgcgccgtcgccgtcgataacgtgaagggtgtcgccgtcatagactttggacaccgtgcctgtgtagcggtggccggatttcgccgatgctcggcggcgggcgggcgcgtcggaacccgcgtcccctgccgcgccgagtacgtcgagtacggcaaccgccgtccgcaccgcctcgctgccgtaccccgtataacccaacgcacccaaaagcgacaaggcgacgggaagccatttcatgatttttttaatctgcatatttttcaaatgccgatgccgtctgaacatatcggaatcggatttcagacggcatcttaa

SEQ ID NO: 850 - protein, 309 aa, Neisseria meningitidis
MSKRKSINRPYQKPAELPPLQNNPPFYRKNRRLNFFIAADGGCASPQKCRARGFQTAFAVQSRAVSLPNAQPFAHGIHPILIAPAAPACPAVRPRRLRIFSFPQSFAFPFRLNLSVGIIGKIRLILLFFSITFIMPRRPVLHLHQVQIGFADRNLRHFALVAVGVEHADADFPAFRRRAQVVARTRAVSLFHLRRVDIRHPDFVFRAVAVDNVKGVAVIDFGHRACVAVAGFRRCSAAGGRVGTRVPCRAEYVEYGNRRPHRLAAVPRITQRTQKRQGDGKPFHDFFNLHIFQMPMPSEHIGIGFQTAS

SEQ ID NO: 851 - DNA, 873 bp, Neisseria gonorrhoeae
atgatgggcaacagcctgattgaatccggtacgtttgtcgccatcctgtttggtcagattttgggaacggcggttgccggcgcgccgccttatattgtcgggatactggttttgctggtcgccgtcggaggaacggccggcagcctgtttatgccgtccgtacccgccaaggctgccgatacccaaatcgagtggaatattgtccgtggtacaaaatccctgctgcgtgaaacggtgcggcacaatcccgtttttaccgccattatcggcatctcgtggttttggtttgtcggcgcggtttataccacgcaactgccgacctttacccaaatccatttgggcggcaacgataatgtttttaacctgatgcttgctttgttttccatcggtattgccgccggttcggtactgtgtgccaagttcggcagggaacggctgatgttggcttgggtaacggttggtgcgttgggttcgacggtttgcggcctggttttggtgtggctgacgcacggacaccgttttgaagggctgaacggcattttttggtttttatcgcaaggatgggcataccccgtgatggcggtgatgacgctgatcggctttttcggcggatttttctccgttccgctctatacctggctgcaaaccgccagcagcgagactttccgcgcccgcgccgttgccgccaacaatatcgttaacggcatctttatggtttccgccgccgttttgagcgcggtattgctgtttttgtttgacagcatttccctgctgtatctgattgtcgccttgggcaatattccgttggcggtatttttgattaagcgcgaaaggcggtttttaggcgcggcggcaatcaggaaaaaaccttga

SEQ ID NO: 852 - protein, 290 aa, Neisseria gonorrhoeae
MMGNSLIESGTFVAILFGQILGTAVAGAPPYIVGILVLLVAVGGTAGSLFMPSVPAKAADTQIEWNIVRGTKSLLRETVRHNPVFTAIIGISWFWFVGAVYTTQLPTFTQIHLGGNDNVFNLMLALFSIGIAAGSVLCAKFGRERLMLAWVTVGALGSTVCGLVLVWLTHGHRFEGLNGIFWFLSQGWAYPVMAVMTLIGFFGGFFSVPLYTWLQTASSETFRARAVAANNIVNGIFMVSAAVLSAVLLFLFDSISLLYLIVALGNIPLAVFLIKRERRFLGAAAIRKKP

SEQ ID NO: 853 - DNA, 868 bp, Neisseria meningitidis
atgatgggcaacagcctgattgaatcgggtacgtttgtcgccatcctgttcggtcagattttgggaacggcggtggcaggtgtaccgccttatattgtcgggatactggttttgctggtcgccgtcggaggcacggtcggcagcctgtttatgccgtccgtacccgccaaggctgccgatacacaaattgagtggaatattgtccgtggcacaaaatccctgctgcgtgaaacggtgcggcacaagcccgtttttaccgccattatcggtatttcgtggttttggtttgtcggcgcggtttataccacgcaactgccgacctttacccaaatccatctgggcggcaacgacaatgttttcaacctgatgcttgctctgttttccatcggtattgccgccggttcggtactgtgtgccaagttcagcakggaacgcctgatgttggcttgggtaacggttggtgcgttgggtttgacggtttgcggcttggttttggtgtggctgacgcacggacaccgttttgaagggctgaacggcattttttrgtttttatcgcaaggatgggcatatcccgtgatggcggtgatgacgctgatcggctttttcggcggatttttctccgttccgctctatacctgtgcaaaccgccatagcgagatttccgcgcccggccgttgccgccaacaatatcgttaacggtatttttatggtttccgctgccgttttgagcgcggtgttgctgtttttgtttgacagcatttccttgttgtatctgattgtcgctttgggcaatattccgttgtcggtatttttgattaagcgcgaaaggcggtttttaggcgcggcggcaatcaggaaaaaaccttga

SEQ ID NO: 854 - protein, 288 aa, Neisseria meningitidis
  misc_feature (143)..(143): Xaa can be any naturally occurring amino acid
  misc_feature (182)..(182): Xaa can be any naturally occurring amino acid
MMGNSLIESGTFVAILFGQILGTAVAGVPPYIVGILVLLVAVGGTVGSLFMPSVPAKAADTQIEWNIVRGTKSLLRETVRHKPVFTAIIGISWFWFVGAVYTTQLPTFTQIHLGGNDNVFNLMLALFSIGIAAGSVLCAKFSXERLMLAWVTVGALGLTVCGLVLVWLTHGHRFEGLNGIFXFLSQGWAYPVMAVMTLIGFFGGFFSVPLYTVQTAIARFPRPAVAANNIVNGIFMVSAAVLSAVLLFLFDSISLLYLIVALGNIPLSVFLIKRERRFLGAAAIRKKP

SEQ ID NO: 855 - DNA, 1311 bp, Neisseria meningitidis
atgtacgctaaaaaaggcggtttgggactggttaaaagccgccgtttcgcacctcttttcgctacgcagtttctcggcgcgttcaacgacaatgtgttcaaaaccgcgctgtttgtgatgattgggttttacggtttggggcaaaacggcttcctgcctgccggacagatgttgaacttgggcgcgttgctgtttattttgccgtatttcctgttttcctcgctgtcggggcagttgggtaacaaattcgacaaggccgttttggcgcgttgggccaaggtgctggaaatgatcattatggcggtggcggcatacgggttttatatccggtctgccccgctgcttttggcgtgtctgttttgcatgggcgcgcaatcgacgctgttcgggccgctgaaatacgccatcctgcccgattatctcgacgacaaagagttgatgatgggcaacagcctgattgaatcgggtacgtttgtcgccatcctgttcggtcagatactggggactgcggtggcaggtgtaccgccttatattgtcgggatactggttttgctggtcgccgtaggaggcacggtcggcagcctgtttatgccgtccgtacccgccaaggctgccgatacacaaattgagtggaatattgtccggggtacaaaatccctgctgcgtgaaacggtgcggcacaagcccgtttttaccgccattatcggtatttcgtggttttggtttgtcggcgcggtttataccacgcaactgccgacctttacccaaatccatctaggcggcaacgacaatgttttcaacctgatgcttgccctgttttccatcggtattgccgccggttcggtactgtgtgccaagttcagcagggaacggctgaggttggcttgggtaacggttggtgcgttgggtttgacggtttgcggcttggttttggtgtggctgacgcacggacaccgttttgaagggctgaacggcattttttggtttttatcgcaaggatgggcatatcccgtgatggcggtgatgacgctgatcggctttttcggcggatttttctccgttccgctctatacctggctgcaaaccgccagtagcgagactttccgcgcccgcgccgttgccgccaacaatatcgttaacggtatttttatggtttccgctgccgttttgagcgcggtgttgctgtttttgtttgacagcatttccttgttgtatctgattgtcgctttgggcaatattccgttgtcggtatttttgattaagcgcgaaaggcggtttttaggcgcggcggcaatcaggaaaaaaccttga

SEQ ID NO: 856 - protein, 436 aa, Neisseria meningitidis
MYAKKGGLGLVKSRRFAPLFATQFLGAFNDNVFKTALFVMIGFYGLGQNGFLPAGQMLNLGALLFILPYFLFSSLSGQLGNKFDKAVLARWAKVLEMIIMAVAAYGFYIRSAPLLLACLFCMGAQSTLFGPLKYAILPDYLDDKELMMGNSLIESGTFVAILFGQILGTAVAGVPPYIVGILVLLVAVGGTVGSLFMPSVPAKAADTQIEWNIVRGTKSLLRETVRHKPVFTAIIGISWFWFVGAVYTTQLPTFTQIHLGGNDNVFNLMLALFSIGIAAGSVLCAKFSRERLRLAWVTVGALGLTVCGLVLVWLTHGHRFEGLNGIFWFLSQGWAYPVMAVMTLIGFFGGFFSVPLYTWLQTASSETFRARAVAANNIVNGIFMVSAAVLSAVLLFLFDSISLLYLIVALGNIPLSVFLIKRERRFLGAAAIRKKP

SEQ ID NO: 857 - DNA, 690 bp, Neisseria gonorrhoeae
atgaaacgcaaaaatatcgcgctgattcccgccgccggcatcggggtgcgtttcggtgcggacaaacccaagcaatatgtcgaaatcggaagcaaaaccgttttagaacatgtacttgggatttttgaacggcatgaggccgtcgatttgaccgtcgttgtcgtctcgcccgaagacacgtttgccgataaggttcagacggcatttccacaggttcgggtgtggaaaaacggtggacagacccgcgccgaaactgtccgcaacggtgtggcaaaactgttggaaaccggtttggcggcggaaaccgacaatattctggtacacgatgccgcccgctgctgcctgccgtctgaagctctggcgcggttgatagaacaggcgggcaacgccgccgaaggcgggattttggcagttcccgttgccgatacgctcaagcgcgcagaaagcggacaaatcagtgcaactgtcgaccgttcggggctttggcaggcgcaaacgccgcagctttttcaagcgggtttgctgcaccgcgcattggctgcggaaaacttgggcggcattaccgatgaagcgtccgccgtggaaaaactgggtgtgcgtccgctactgatacagggcgacgcgcgcaatttgaaactgacgcagccgcaggacgcatacatcgtcaggctgctgctcaatgccgtctga

SEQ ID NO: 858 - protein, 229 aa, Neisseria gonorrhoeae
MKRKNIALIPAAGIGVRFGADKPKQYVEIGSKTVLEHVLGIFERHEAVDLTVVVVSPEDTFADKVQTAFPQVRVWKNGGQTRAETVRNGVAKLLETGLAAETDNILVHDAARCCLPSEALARLIEQAGNAAEGGILAVPVADTLKRAESGQISATVDRSGLWQAQTPQLFQAGLLHRALAAENLGGITDEASAVEKLGVRPLLIQGDARNLKLTQPQDAYIVRLLLNAV

SEQ ID NO: 859 - DNA, 456 bp, Neisseria meningitidis
atgaagcgcaaaaatatcgcgctgattcccgccgccggcatcggggcgcgtttcggtgcggacaaacccaagcaatatgtcgaaatcggaagcaaaaccgttttagaacatacgattgggatttttgaacggcatgaggccgtcgatttgaccgtcgttgtcgtctcgcccgaagacacgtttgccgataaggttcagacggcatttccacaggttcgggtgtggaaaaacggcggacagacccgcgccgaaaccgtccgcaacggtgtggcaaaactgttggaaaccggtttggcggcggaaaccgacaatattctggtacacgatgccgcgcgttgctgcctgccgtctgaagctttgacgcggttgatagaacaggcgggcaacgccgccgaaggcgggattttggcaattcccattgccgatacgctcaagtgcgcggacggtgggaacatt

SEQ ID NO: 860 - protein, 152 aa, Neisseria meningitidis
MKRKNIALIPAAGIGARFGADKPKQYVEIGSKTVLEHTIGIFERHEAVDLTVVVVSPEDTFADKVQTAFPQVRVWKNGGQTRAETVRNGVAKLLETGLAAETDNILVHDAARCCLPSEALTRLIEQAGNAAEGGILAIPIADTLKCADGGNI

SEQ ID NO: 861 - DNA, 690 bp, Neisseria meningitidis
atgaagcgcaaaaatatcgcgctgattcccgccgccggcatcggggcgcgtttcggtgcggacaaacccaagcaatatgtcgaaatcggaagcaaaaccgttttagaacatacgattgggatttttgaacggcatgaggccgtcgatttgaccgtcgttgtcgtctcgcccgaagacacgtttgccgataaggttcagacggcatttccacaggttcgggtgtggaaaaacggcggacagacccgcgccgaaactgtccgcaacggtgtggcaaaattgttggaaaccggtttggcggcggaaaccgacaatattctggtacacgatgccgcgcgttgctgcctgccgtctgaagctttgacgcggttgatagaacaggcgggcaacgctgccgaaggtgggattttggcaattcccgttgccgatacgctcaagtgcgcggacggtgggaacattagtgcaaccgtcgagcggacgagcctttggcaggcgcaaacgccgcagcttttccgcgccgggctgctgcaccgcgcattggctgcggaaaacttggacggcattaccgatgaagcgtccgccgtggaaaaattgggcatccgccctttgctggtgcagggcgacgcgcgcaatttgaaactgacgcagccgcaggacgcatacatcgtcaggctgctgctcgatgccgtctga

SEQ ID NO: 862 - protein, 229 aa, Neisseria meningitidis
MKRKNIALIPAAGIGARFGADKPKQYVEIGSKTVLEHTIGIFERHEAVDLTVVVVSPEDTFADKVQTAFPQVRVWKNGGQTRAETVRNGVAKLLETGLAAETDNILVHDAARCCLPSEALTRLIEQAGNAAEGGILAIPVADTLKCADGGNISATVERTSLWQAQTPQLFRAGLLHRALAAENLDGITDEASAVEKLGIRPLLVQGDARNLKLTQPQDAYIVRLLLDAV

SEQ ID NO: 863 - DNA, 672 bp, Neisseria gonorrhoeae
atgaaaaccgtttccgccgccatcgcttttgccgccgctgccgtttcactgaccggctgtgcgaccgagtcctcacgcagcctcgaggttgcaaaagtcgcctcctgcaatacgcaatatcacggtgttcgcaccccgatttccgtcggaacattcgacaaccgctccagcttccaaaaaggcattttctccgacagtgaagaccgtctgggcagccaggcaaaaaccatcctggtaacacacctgcaacaaaccaaccgcttcaacgtactgaaccgcaccaaccttagcgcattgaaacaggaatccggcatttccggcaaagcgcagaacctgaaaggcgcagattatgtcgttaccggcgatgtaaccgaattcggacgcagagatgtcggcgatcatcagctcttcggcattttgggtcgcggcaaatcgcaaatcgcctatgcaaaagtggctctgaatatcgtcaacgtcaatacttccgaaatcgtctattccacacagggcgcgggcgaatacgcactttccaaccgcgaaatcatcggtttcggcggcacttccggctacgatgcgactttgaacggcaaagttttagacttggcaatccgcgaagccgtcgacaacttggttcaggctgtcgacaacggcgcatggcaatccaaccgttaa

SEQ ID NO: 864 - protein, 223 aa, Neisseria gonorrhoeae
MKTVSAAIAFAAAAVSLTGCATESSRSLEVAKVASCNTQYHGVRTPISVGTFDNRSSFQKGIFSDSEDRLGSQAKTILVTHLQQTNRFNVLNRTNLSALKQESGISGKAQNLKGADYVVTGDVTEFGRRDVGDHQLFGILGRGKSQIAYAKVALNIVNVNTSEIVYSTQGAGEYALSNREIIGFGGTSGYDATLNGKVLDLAIREAVDNLVQAVDNGAWQSNR

SEQ ID NO: 865 - DNA, 164 bp, Neisseria meningitidis
ggcgcgggcgaatacgcactttccaaccgtgaaatcatcggtttcggcggcacttccggctacgatgcgactttgaacggcaaagttttagacttggcaatccgcgaagcgtcaacagcctggttcaggctgttgacaacggcgcatggcaacccaaccgttaa

SEQ ID NO: 866 - protein, 54 aa, Neisseria meningitidis
GAGEYALSNREIIGFGGTSGYDATLNGKVLDLAIREAVNSLVQAVDNGAWQPNR

SEQ ID NO: 867 - DNA, 399 bp, Neisseria meningitidis
  misc_feature (83)..(84): n is a, c, g, or t
  misc_feature (113)..(113): n is a, c, g, or t
aaccgcacctatttgaacgcattaaaacaggaatccggcatttccggcaaagcgcataacctgaaaggcgcaaattatgtcgnnaccggcgatgtaaccgaattcggacgcanagatgtcggcgatcatcagctcttcggcattttgggtcgcggcaaatcgcaaatcgcctatgcaaaagtggctctgaatatcgtcaacgtcaatacttccgaaatcgtctattccgcacagggcgcgggcgaatacgcactttccaaccgtgaaatcatcggtttcggcggcacttccggctacgatgcgactttgaacggcaaagttttagacttggcaatccgcgaagccgtcaacagcctggttcaggctgttgacaacggcgcatggcaacccaaccgttaa

SEQ ID NO: 868 - protein, 132 aa, Neisseria meningitidis
  misc_feature (28)..(28): Xaa can be any naturally occurring amino acid
  misc_feature (38)..(38): Xaa can be any naturally occurring amino acid
NRTYLNALKQESGISGKAHNLKGANYVXTGDVTEFGRXDVGDHQLFGILGRGKSQIAYAKVALNIVNVNTSEIVYSAQGAGEYALSNREIIGFGGTSGYDATLNGKVLDLAIREAVNSLVQAVDNGAWQPNR

SEQ ID NO: 869 - DNA, 648 bp, Neisseria gonorrhoeae
atgaaacctttgattttagggcttgccgccgtgttggctctgtctgcctgccaagttcgaaaagctcccgacctcgactacacgtcattcaaagaaagcaaaccggcttcaattttggtggttccgccgctgaacgagtcgcctgatgtcaacggcacttgggggatgctggcttcgaccgccgcgccgatttccgaagccggctattacgtctttcccgccgcagtcgtggaggaaaccttcaaagaaaacggcttgaccaatgccgccgatattcacgccgtccggccggaaaaactgcatcaaattttcggcaatgatgcggttttgtacattacggttaccgaatacggcacttcatatcaaattttagacagcgtgacgaccgtatccgccaaagcacggctggtcgattcccgcaacgggaaagagttgtggtcgggttcggccagcatccgcgaaggcagcaacaacagcaacagcggcctgttgggggctttggtcggcgcagtggtcaatcagattgccaacagcctgaccgaccgcggttatcaggtttccaaaaccgccgcatacaacctactgtcgccctattcccgcaacggtatcttgaaaggtccgagattcgtcgaagagcagcccaaataa

SEQ ID NO: 870 - protein, 215 aa, Neisseria gonorrhoeae
MKPLILGLAAVLALSACQVRKAPDLDYTSFKESKPASILVVPPLNESPDVNGTWGMLASTAAPISEAGYYVFPAAVVEETFKENGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSRNGILKGPRFVEEQPK

SEQ ID NO: 871 - DNA, 648 bp, Neisseria meningitidis
atgaaacctttgattttagggcttgccgccgtgttggcgctgtctgcctgccaagttcaaaaagcgcccgatttcgactacacgtcattcaaggaaagcaaaccggcttcaattttggtggttccgccgctgaacgaatcgcccgatgtcaacggaacatggggtgtactggcttcgaccgccgcgccgctttccgaagccggctattacgtcttccccgccgcagtcgtggaggaaaccttcaaacaaaacggcttgaccaatgccgccgatattcacgccgtccggccggaaaaactgcatcagattttcggcaatgatgcggttttgtacattacggttaccgaatacggcacttcatatcaaattttagacagcgtgacgaccgtatccgccaaagcacggctggtcgattcccgcaacggaaaagagttgtggtcgggttcggccagcatccgcgaaggcagcaacaacagcaacagcggcctgttgggggctttggtcagcgcagtggtcaatcagattgccaacagcctgaccgaccgcggttatcaggtttccaaaaccgccgcatacaacctgctgtcgccctattctcacaacggcatcttgaaaggtccgagattcgttgaagagcagcccaaataa

SEQ ID NO: 872 - protein, 215 aa, Neisseria meningitidis
MKPLILGLAAVLALSACQVQKAPDFDYTSFKESKPASILVVPPLNESPDVNGTWGVLASTAAPLSEAGYYVFPAAVVEETFKQNGLTNAADIHAVRPEKLHQIFGNDAVLYITVTEYGTSYQILDSVTTVSAKARLVDSRNGKELWSGSASIREGSNNSNSGLLGALVSAVVNQIANSLTDRGYQVSKTAAYNLLSPYSHNGILKGPRFVEEQPK

SEQ ID NO: 873 - DNA, 648 bp, Neisseria meningitidis
atgaaacctttgattttagggcttgccgccgtgttggcgctgtctgcctgccaagttcaaaaagcgcccgatttcgactacacgtcattcaaggaaagcaaaccggcttcaattttggtggttccgccgctgaacgaatcgcccgatgtcaacggaacatggggtgtactggcttcgaccgccgcgccgctttccgaagccggctattacgtcttccccgccgcagtcgtggaggaaaccttcaaacaaaacggcttgaccaatgccgccgatattcacgccgtccggccggaaaaactgcatcagattttcggcaatgatgcggttttgtacattacggttaccgaatacggcacttcatatcaaattttagacagcgtgacgaccgtatccgccaaagcacggctggtcgattcccgcaacggaaaagagttgtggtcgggttcggccagcatccgcgaaggcagcaacaacagcaacagcggcctgttgggggctttggtcagcgcagtggtcaatcagattgccaacagcctgaccgaccgcggttatcaggtttctaaaaccgccgcatacaacctgctgtcgccctattctcacaacggcatcttgaaaggtccgagattcgtcgaagagcagcccaaataa

SEQ ID NO: 874 - protein, 215 aa, Neisseria meningitidis; identical to SEQ ID NO: 872

SEQ ID NO: 875 - DNA, 1038 bp, Neisseria gonorrhoeae
atggcgcgtttcgccttctccgccgacattctccgcacagcgtttgcagacggtttcataacctgcaaccgcgcccacatcgcgggtgtaatgccagcagcgttcgcatttttcgccgtcgctggctttggcggcaacggcaagttcatcaccgactttcacttctgctttagacaccagcagggcaaagcgcaattcttcgcccaaagcattcagatagccggccatttcttccggcgcggtaatttcggcttccgcctgcaaggacgaaccgacagttttgtcggcgcgcaaaggctcgatagcggcggttactgcttcgcgcgcttcgcggattgccgtccattttttcaccagttcggcttcggctttttcgttgatggccgggaactcgtgccaagtatggaagaggacgctgtcttcttcgccgccgccgatgatgtcccacgcttcttcgccggtgaagcacaaaatcggtgcaatcaagagaaccaggctgcgcgtgatgtggtacagggcggtttgcgcgctgcggcgggcgcggctgtcggctttggtggtgtagaggcggtctttcaggatgtcgaggtagaacgcgcccaagtcttccgagcagaaagaaacaatgtctttcacggcgaagtggaaggcatagcgcggatagtaaccgcctgccaaacgctcttgcagccgccgcgccaataccaaggcgtagcggtcgatttccaccatatccgcctgttgcacggcatcttcaatcggattaaagtcgctcaaattggcaaacaggaagctcaaggtattgcggatgcggcggtagctttcggtaacgcgtttgaggatttctttggaaatcgccaattcgccgctgtaatcggtggatgccgcccacaggcgcaggatgtccgcgccgaattcgttatagacttcctgcggcgcgacgacgttgccgatggatttcgacattttgcggccgttttggtcaaccacgaaaccgtgggtcagcagctgtttatacggtgcgcgtcccatggatga

SEQ ID NO: 876 - protein, 345 aa, Neisseria gonorrhoeae
MARFAFSADILRTAFADGFITCNRAHIAGVMPAAFAFFAVAGFGGNGKFITDFHFCFRHQQGKAQFFAQSIQIAGHFFRRGNFGFRLQGRTDSFVGAQRLDSGGYCFARFADCRPFFHQFGFGFFVDGRELVPSMEEDAVFFAAADDVPRFFAGEAQNRCNQENQAARDVVQGGLRAAAGAAVGFGGVEAVFQDVEVERAQVFRAERNNVFHGEVEGIARIVTACQTLLQPPRQYQGVAVDFHHIRLLHGIFNRIKVAQIGKQEAQGIADAAVAFGNAFEDFFGNRQFAAVIGGCRPQAQDVRAEFVIDFLRRDDVADGFRHFAAVLVNHETVGQQLFIRCASHG

SEQ ID NO: 877 - DNA, 777 bp, Neisseria meningitidis
ttgcacggacgaaccgacggttttgtcggcgcgcaaaggctcgatggcggcggttaccgcttcgcgggcttcgcggattgccgtccattttttcaccagttcggcttcggttttttcgttgatggtcgggaactcgtgccaagtatggaagaggacgctgtcktcttcgccgccgccgwtgaygtcccacgcttcttcgccggtgaagcacaaaatcggtgcaatcaagagaaccaaactgcgtgtgatgtgatacagggcagtttgtgcgctgcggcgtgcatggctgtctgctttggtggtgtagaggcggtctttcaggatgtcgaggtagaacgcacccaagtcttccgagcagaaagaaacartgtcttttacggcaaagtggaakgcataacgcggatagtaatcgcctgccagacactcttgcagctgacgtgccaataccacggcgtagcggtcgatttccaccatatccgcctgttgcacggcatcttcaatcggattaaagtcgctcaagttggcaaacaaaaagctcaaggtattgcggatacggcggtagctttcggttacgcgtttgaggatttctttggaaatcgccaattcgccgctgtaatcggtagatgccgcccacaggcgcaggatgtctgcgccgaattcgttataaacctcttgcggtgcaacgacgttgccgatggatttcgacatttttttgccttcgccgtcgacaacgaaaccatgggtcagcagctgtttatacggcgcgcgacccattga

SEQ ID NO: 878 - protein, 258 aa, Neisseria meningitidis
  misc_feature (55)..(55): Xaa can be any naturally occurring amino acid
  misc_feature (60)..(60): Xaa can be any naturally occurring amino acid
  misc_feature (123)..(123): Xaa can be any naturally occurring amino acid
  misc_feature (131)..(131): Xaa can be any naturally occurring amino acid
LHGRTDGFVGAQRLDGGGYRFAGFADCRPFFHQFGFGFFVDGRELVPSMEEDAVXFAAAXDVPRFFAGEAQNRCNQENQTACDVIQGSLCAAACMAVCFGGVEAVFQDVEVERTQVFRAERNXVFYGKVEXITRIVIACQTLLQLTCQYHGVAVDFHHIRLLHGIFNRIKVAQVGKQKAQGIADTAVAFGYAFEDFFGNRQFAAVIGRCRPQAQDVCAEFVINLLRCNDVADGFRHFFAFAVDNETMGQQLFIRRATH

SEQ ID NO: 879 - DNA, 1035 bp, Neisseria meningitidis
atggcgcgtttcgccttctccgccgacattctctgcacagcgtttgcagacggtttcatggcctgcaaccgcgcccacatcgcgggtgtagtgccagcagcgttcgcatttttcaccatcactggctttagcggcaacggcaagttcgctgcctactttcacttctgctttagacaccagcaaagcaaagcgcaattcttcgcccaaagcattcagatagccggccatttcttccggcgcggtaatttcggcttcggcttgcaaggacgaaccgacggttttgtcggcgcgcaaaggctcgatggcggcggttaccgcttcgcgggcttcgcggattgccgtccattttttcaccagttcggcttcggctttttcgttgatggtcgggaactcgtgccaagtatggaaaagcacgctgtcttctgcgccgccgccgatgatgtcccacgcttcttcgccggtgaagcacaaaatcggtgcaatcaagagaaccaggctgcgcgtgatgtggtacagggcggtttgcgcgctgcggcgggcgcggctgtcggctttggtggtatagaggcggtctttcaggatatcgaggtagaacgcgcccaagtcttccgagcagaaagaaaccatttctttcacggcaaagtggaaggcataacgcggataaaaatcaccggcaacgcgttcttgcagccgccttgccaacaccaaggcatagcggtcgatttccaccatatccgcctgttgcacggcatcttcaataggattgaagtcgctcaagttggcaaacaaaaagctcaaggtattgcggatacggcggtagctttcggttacgcgcttgaggatttctttggaaatcgccaattcgccgctgtaatcggtggatgccgcccacaggcgcaggatgtccgcgccgaactcgttatacacttcttgcggcgcgacgacgttgccgatggatttcgacattttgcgcccgttttgatccaccacgaaaccatgggtcagcagctgtttgtacggcgcgcgacccattga

SEQ ID NO: 880 - protein, 344 aa, Neisseria meningitidis
MARFAFSADILCTAFADGFMACNRAHIAGVVPAAFAFFTITGFSGNGKFAAYFHFCFRHQQSKAQFFAQSIQIAGHFFRRGNFGFGLQGRTDGFVGAQRLDGGGYRFAGFADCRPFFHQFGFGFFVDGRELVPSMEKHAVFCAAADDVPRFFAGEAQNRCNQENQAARDVVQGGLRAAAGAAVGFGGIEAVFQDIEVERAQVFRAERNHFFHGKVEGITRIKITGNAFLQPPCQHQGIAVDFHHIRLLHGIFNRIEVAQVGKQKAQGIADTAVAFGYALEDFFGNRQFAAVIGGCRPQAQDVRAELVIHFLRRDDVADGFRHFAPVLIHHETMGQQLFVRRATH

SEQ ID NO: 881 - DNA, 1149 bp, Neisseria gonorrhoeae
atgcgggacaaggttggcggtaatatcgcactccccgccccacgaatattcgattctaacatcggcaagctgcggaaaaactttaagcatatcttggcggacaagctcggtcatacgcgcaggattgtcgataaattcgttatccttaccgccgaaaagcagcctgccgtccgcgctgaggcggtaataatccaaaatatggcggttgtcgcatactgccatattgttgcggataagcccttttgtgcgcgcgcccaagggttcggtggcaataataaaggtgctgacggcaatcgccttgcgttccaaaggccggaatatcgggttcaaaccgacataagtattgacggcatagaccacatttttacactcgacgctgccttcgggcgtgtaaaccagccaaccgttttgatacggttcgatgcgcgtcatcggggattgctcgaaaatctgcgcgccggcttcggcagcggcgctggcaacacccaacgtgtaattgagcggatgaagatgcccggacaagggatcgaactgtgcgccttggtacatatcgctgtcaagctgctgtttcaactcggctttatcccaaagttgataatgactcgcaccgtaatgccgttgggcgtgttcatgccactgctgcaactcttcccaatgctgcggacggacggcaaccgtggcataaccgcgctgccaatcgcaatcgatggcatgtttgcggacgcgttcgtccaccagttcgaccgcctgcaaagactgttgccaaaaccattgcgcctgctccaagccgacctgtttttcaatttcccccataccgcaggcgtagtcgctgataacctgcccgccactcctgccggacgcgccgaagccgatacgtgcggcttccaaaacgacggcttcatgtccgtgttccgccagcggcaatgcggtacacaaaccgctcaaaccgccgccgataatgcaggtttcggctttcagacggcattggagtttcggataaacagtatgcggattaaccgaactaaaataataagaaggcagatattcttgaaaatcagggcgaatcattgtgtttgctttatcgggtatattttcggacggaatgatacagactgtcgggccatatcgtccaaacagaaaatcggttga

SEQ ID NO: 882 - protein, 382 aa, Neisseria gonorrhoeae
MRDKVGGNIALPAPRIFDSNIGKLRKNFKHILADKLGHTRRIVDKFVILTAEKQPAVRAEAVIIQNMAVVAYCHIVADKPFCARAQGFGGNNKGADGNRLAFQRPEYRVQTDISIDGIDHIFTLDAAFGRVNQPTVLIRFDARHRGLLENLRAGFGSGAGNTQRVIERMKMPGQGIELCALVHIAVKLLFQLGFIPKLIMTRTVMPLGVFMPLLQLFPMLRTDGNRGITALPIAIDGMFADAFVHQFDRLQRLLPKPLRLLQADLFFNFPHTAGVVADNLPATPAGRAEADTCGFQNDGFMSVFRQRQCGTQTAQTAADNAGFGFQTALEFRINSMRINRTKIIRRQIFLKIRANHCVCFIGYIFGRNDTDCRAISSKQKIG

SEQ ID NO: 883 - DNA, 1149 bp, Neisseria meningitidis
  misc_feature (821)..(821): n is a, c, g, or t
atgcgggacaaggttggcggtaatgtcgcactccccgccccacgaatattcgattttgacatcggcaagctgcggaaaaactttaagcatatcttggcggacaagctcggtcatacgctcaggattgtcgataaactcgttatccttaccgccgaaaagcagtctgccgtccgcgctgaggcggtaataatccaaaatatggcggttgtcgcatactgccatattgttacggataagcccttttgcgcgcgcccccaagggttcggtcgcaataataaaggtgctgacagcaatcgccttgcgttccaaaggccggaatatcgggttcaaacctgcataagtattgacagcatagaccacatttttgcactcgacgctgccttcgggcgtgtaaaccagccaaccgttttgatgcggttcgatgcacgtcatcggggattgctcgaaaatctgcgcaccggcttcggcagcggcacgagcgatgcccaaagtgtaagtgagcggatgcaggtgtccggataaggggtcgaattgtgccccttggtacatatcgctgtcaagctgctgtttcaactcggctttatcccaaagttgataatgactcgcaccgtaatgccgttgggcgtgttcatgccactgctgcaactcttcccaatgctgcggacggacggcaaccgtggcataaccgcgctgccaatcacaatcgacggcatgtttgcggacgcgttcgtccaccagttcgaccgcctgcaaagactgttgccaaaaccattgcgcctgctccaagccgacctgtttttcaatttcccccataccgcagncgtaatcgctgataacctgcccgccactccgtcccgacgcgccgaaaccgatacgcgcggcttccaacacaaccgtttcatgtccctgctccgccaagggcaatgcagtgcacaaaccacccaatccgccgccgatgatacaggtatcggttttcagacggcattgaagtttcggataaacagtatgaggattaaccgaactgaaataataagaaggcagatattcttgaaaatcagggcgaatcattgtgtttgctttatcaggtgtattttcggacggaatgatacaggctgtcgggccatatcgtccawacagaaaatcggttga

SEQ ID NO: 884 - protein, 382 aa, Neisseria meningitidis
  misc_feature (174)..(174): Xaa can be any naturally occurring amino acid
  misc_feature (274)..(274): Xaa can be any naturally occurring amino acid
  misc_feature (378)..(378): Xaa can be any naturally occurring amino acid
MRDKVGGNVALPAPRIFDFDIGKLRKNFKHILADKLGHTLRIVDKLVILTAEKQSAVRAEAVIIQNMAVVAYCHIVTDKPFCARPQGFGRNNKGADSNRLAFQRPEYRVQTCISIDSIDHIFALDAAFGRVNQPTVLMRFDARHRGLLENLRTGFGSGTSDAQSVSERMQVSGXGVELCPLVHIAVKLLFQLGFIPKLIMTRTVMPLGVFMPLLQLFPMLRTDGNRGITALPITIDGMFADAFVHQFDRLQRLLPKPLRLLQADLFFNFPHTAXVIADNLPATPSRRAETDTRGFQHNRFMSLLRQGQCSAQTTQSAADDTGIGFQTALKFRINSMRINRTEIIRRQIFLKIRANHCVCFIRCIFGRNDTGCRAISSXQKIG

SEQ ID NO: 885 - DNA, 1149 bp, Neisseria meningitidis
atgcgggacaaggttggcggtaatgtcgcactccccgccccacgaatattcgattttgacatcggcaagctgcggaaaaactttaagcatatcttggcggacaagctcggtcatacgcgcgggattgtcgataaactcgttatccttaccgccgaaaagcagtctgccgtccgcgctgaggcggtaataatccaaaatatgacggttgtcgcatactgccatattgttgcggataagcccttttgcacgcgcgcccaagggttctgtggcaataataaaggtgctgacagcaatcgccttgcgctccaaaggcttgaatatcggattcaaaccggcataagtattgacggcgtacaccagatttttgcattcgacgctgccttcgggggtgtaaaccagccaaccgttttgataaggttcaatgcgtatcatgggagaatgctcaaaaatcttcgtaccagcttcggcagcggcgcgggcgatgcccaacgtgtaattgagcggatggagatgcccggacaagggatcgaactgtgcgccttggtacatatcgctgtcaagctgctgcttcagttcagtgttatcccagagttgataatgagttgcaccgtaatatttttgggcgtgctcatgccattgttgcaattcttcccaatgctgcgaacggatggcaaccgtggcataaccgcgctgccaatcgcaatcaatggcatgtttgcggacgcgttcgtccaccagttcgaccgcctgcaaagactgttgccaaaaccattgcgcttgctccaaaccgacctgtttttcaatttcctccataccgcaggcgtaatcgctgataacctgcccgccactccgtcccgacgcgccgaaaccgatacgcgcggcttccaacacaaccgtttcatgtccctgctccgccaagggcaatgcagtgcacaaaccactcaatccgccgccgatgatacaggtatcggttttcagacggcattgaagtttcggataaacagtatgaggattaaccgaactgaaataataagaaggcagatattcttgaaaatcagggcgaatcattgtgtttgctttatcgggtatattttcggacggaatgatacaggctgtcgagccatatcgtccaaacagaaaatcggttga

SEQ ID NO: 886 - protein, 382 aa, Neisseria meningitidis
MRDKVGGNVALPAPRIFDFDIGKLRKNFKHILADKLGHTRGIVDKLVILTAEKQSAVRAEAVIIQNMTVVAYCHIVADKPFCTRAQGFCGNNKGADSNRLALQRLEYRIQTGISIDGVHQIFAFDAAFGGVNQPTVLIRFNAYHGRMLKNLRTSFGSGAGDAQRVIERMEMPGQGIELCALVHIAVKLLLQFSVIPELIMSCTVIFLGVLMPLLQFFPMLRTDGNRGITALPIAINGMFADAFVHQFDRLQRLLPKPLRLLQTDLFFNFLHTAGVIADNLPATPSRRAETDTRGFQHNRFMSLLRQGQCSAQTTQSAADDTGIGFQTALKFRINSMRINRTEIIRRQIFLKIRANHCVCFIGYIFGRNDTGCRAISSKQKIG

SEQ ID NO: 887 - DNA, 1497 bp, Neisseria gonorrhoeae
atgaatttgcctattcaaaaattcatgatgctgttggcagcggcaatatcgatgctgcatatccccattagtcatgcgaacggtttggatgcccgtttgcgcgatgatatgcaggcaaaacactacgaaccgggtggcaaataccatctgtttggtaatgctcgcggcagtgttaaaaatcgggtttgcgccgtccaaacatttgatgcaactgcggtcggccccatactgcctattacacacgaacggacaggatttgaaggtgttatcggctatgaaacccatttttcaggacacggacacgaagtacacagtccgttcgataatcatgattcaaaaagcacttctgatttcagcggcggcgtagacggcggttttaccgtttaccaacttcatcggacagggtcggaaatacatcccgcagacggatatgacgggcctcaaggcggcggttatccggaaccacaaggggcaagggatatatacagctaccatatcaaaggaacttcaaccaaaacaaagataaacactgttccgcaagcccctttttcagaccgctggctaaaagaaaatgccggtgccgcttccggttttctcagccgtgcggatgaagcaggaaaactgatatgggaaaacgaccccgataaaaattggcgggctaaccgtatggatgatattcgcggcatcgtccaaggtgcggttaatccttttttaacgggttttcaaggggtagggattggggcaattacagacagtgcggtaagcccggtcacagatacagccgctcagcagactctacaaggtattaatgatttaggaaatttaagtccggaagcacaacttgccgccgcgagcctattacaggacagtgcctttgcggtaaaagacggcatcaattccgccagacaatgggctgatgcccatccgaatataacagcaacagcccaaactgcccttgccgtagcagaggccgcaggtacggtttggcgcggtaaaaaagtagaacttaacccgaccaaatgggattgggttaaaaataccggctataaaaaacctgctgcccgccatatgcagactgtagatggggagatggcaggggggaatagaccgcctaaatctataacgtcggaaggaaaagctaatgctgcaacctatcctaagttggttaatcagctaaatgagcaaaacttaaataacattgcggctcaagatccaagattgagtctagctattcatgagggtaaaaaaaattttccaataggaactgcaacttatgaagaggcagatagactaggtaaaatttgggttggtgagggtgcaagacaaactagtggaggcggatggttaagtagagatggcactcgacaatatcggccaccaacagaaaaaaaatcacaatttgcaactacaggtattcaagcaaattttgaaacttatactattgattcaaatgaaaaaagaaataaaattaaaaatggacatttaaatattaggtaa

SEQ ID NO: 888 - protein, 498 aa, Neisseria gonorrhoeae
MNLPIQKFMMLLAAAISMLHIPISHANGLDARLRDDMQAKHYEPGGKYHLFGNARGSVKNRVCAVQTFDATAVGPILPITHERTGFEGVIGYETHFSGHGHEVHSPFDNHDSKSTSDFSGGVDGGFTVYQLHRTGSEIHPADGYDGPQGGGYPEPQGARDIYSYHIKGTSTKTKINTVPQAPFSDRWLKENAGAASGFLSRADEAGKLIWENDPDKNWRANRMDDIRGIVQGAVNPFLTGFQGVGIGAITDSAVSPVTDTAAQQTLQGINDLGNLSPEAQLAAASLLQDSAFAVKDGINSARQWADAHPNITATAQTALAVAEAAGTVWRGKKVELNPTKWDWVKNTGYKKPAARHMQTVDGEMAGGNRPPKSITSEGKANAATYPKLVNQLNEQNLNNIAAQDPRLSLAIHEGKKNFPIGTATYEEADRLGKIWVGEGARQTSGGGWLSRDGTRQYRPPTEKKSQFATTGIQANFETYTIDSNEKRNKIKNGHLNIR

SEQ ID NO: 889 - DNA, 1452 bp, Neisseria meningitidis
atgaatttgcctattcaaaaattcatgatgctgtttgcagcagcaatatcgttgctgcaaatccccattagtcatgcgaacggtttggatgcccgtttgcgcgatgatatgcaggcaaaacactacgaaccgggtggtaaataccatctgtttggtaatgctcgcggcagtgttaaaaagcgggtttacgccgtccagacatttgatgcaactgcggtcagtcctgtactgcctattacacacgaacggacagggtttgaaggtgttatcggttatgaaacccatttttcagggcacggacatgaagtacacagtccgttcgatcatcatgattcaaaaagcacttctgatttcagcggcggtgtagacggcggttttactgtttaccaacttcatcgaacagggtcggaaatccatccggaggatggatatgacgggccgcaaggcagcgattatccgccccccggaggagcaagggatatatacagctattatgtcaaaggaacttcaacaaaaacaaagactaatattgtccctcaagccccattttcagaccgttggctaaaagaaaatgccggtgccgcctctggttttttcagccgtgcggatgaagcaggaaaactgatatgggaaagcgaccccaataaaaattggtgggctaaccgtatggatgatgttcgcggcatcgtccaaggtgcggttaatccttttttaatgggttttcaaggagtagggattggggcaattacagacagtgcagtaagcccggtcacagatacagccgcgcagcagactctacaaggtattaatgatttaggaaaattaagtccggaagcacaacttgctgccgcgagcctattacaggacagtgcttttgcggtaaaagacggtatcaactctgccaaacaatgggctgatgcccatccaaatataacagctactgcccaaactgccctttccgcagcagaggccgcaggtacggtttggagaggtaaaaaagtagaacttaacccgactaaatgggattgggttaaaaataccggttataaaaaacctgctgcccgccatatgcagactttagatggggagatggcaggtgggaataaacctattaaatctttaccaaacagtgccgctgaaaaaagaaaacaaaattttgagaagtttaatagtaactggagttcagcaagttttgattcagtgcacaaaacactaactcccaatgcacctggtattttaagtcctgataaagttaaaactcgatacactagtttagatggaaaaattacaattataaaagataacgaaaacaactattttagaatccatgataattcacgaaaacagtatcttgattcaaatggtaatgctgtgaaaaccggtaatttacaaggtaagcaagcaaaagattatttacaacaacaaactcatatcaggaacttagacaaatga

SEQ ID NO: 890 - protein, 483 aa, Neisseria meningitidis
MNLPIQKFMMLFAAAISLLQIPISHANGLDARLRDDMQAKHYEPGGKYHLFGNARGSVKKRVYAVQTFDATAVSPVLPITHERTGFEGVIGYETHFSGHGHEVHSPFDHHDSKSTSDFSGGVDGGFTVYQLHRTGSEIHPEDGYDGPQGSDYPPPGGARDIYSYYVKGTSTKTKTNIVPQAPFSDRWLKENAGAASGFFSRADEAGKLIWESDPNKNWWANRMDDVRGIVQGAVNPFLMGFQGVGIGAITDSAVSPVTDTAAQQTLQGINDLGKLSPEAQLAAASLLQDSAFAVKDGINSAKQWADAHPNITATAQTALSAAEAAGTVWRGKKVELNPTKWDWVKNTGYKKPAARHMQTLDGEMAGGNKPIKSLPNSAAEKRKQNFEKFNSNWSSASFDSVHKTLTPNAPGILSPDKVKTRYTSLDGKITIIKDNENNYFRIHDNSRKQYLDSNGNAVKTGNLQGKQAKDYLQQQTHIRNLDK

SEQ ID NO: 891 - DNA, 1155 bp, Neisseria meningitidis
atgaatttgcctattcaaaaattcatgatgctgtttgcagcagcaatatcgttgctgcaaatccccattagtcatgcgaacggtttggatgcccgtttgcgcgatgatatgcaggcaaaacactacgaaccgggtggtaaataccatctgtttggtaatgctcgcggcagtgttaaaaatcgggtttacgccgtccaaacatttgatgcaactgcggtcggccccatactgcctattacacacgaacggacaggatttgaaggcattatcggttatgaaacccatttttcaggacatggacatgaagtacacagtccgttcgataatcatgattcaaaaagcacttctgatttcagcggcggcgtagacggtggttttaccgtttaccaacttcatcggacagggtcggaaatccatccggaggatggatatgacgggccgcaaggcagcgattatccgccccccggaggagcaagggatatatacagctactatgtcaaaggaacttcaacaaaaacaaagagtaatattgttccccgagccccattttcagaccgctggctaaaagaaaatgccggtgccgcctctggttttttcagccgtgctgatgaagcaggaaaactgatatgggaaagcgaccccaataaaaattggtgggctaaccgtatggatgatattcgcggcatcgtccaaggtgcggttaatccttttttaatgggttttcaaggagtagggattggggcaattacagacagtgcagtaagcccggtcacagatacagccgcgcagcagactctacaaggtattaatcatttaggaaatttaagtcccgaagcacaacttgcggctgcaaccgcattacaagacagtgcttttgcggtaaaagacggtatcaattccgccagacaatgggctgatgcccatccgaatataactgcaacagcccaaactgcccttgccgtagcagaggccgcaactacggtttggggcggtaaaaaagtagaacttaacccgaccaaatgggattgggttaaaaataccggctataaaacacctgctgttcgcaccatgcatactttggatggggaaatggccggtgggaatagaccgcctaaatctataacgtccaacagcaaagcagatgcttccacacaa

SEQ ID NO: 892 - protein, 385 aa, Neisseria meningitidis
MNLPIQKFMMLFAAAISLLQIPISHANGLDARLRDDMQAKHYEPGGKYHLFGNARGSVKNRVYAVQTFDATAVGPILPITHERTGFEGIIGYETHFSGHGHEVHSPFDNHDSKSTSDFSGGVDGGFTVYQLHRTGSEIHPEDGYDGPQGSDYPPPGGARDIYSYYVKGTSTKTKSNIVPRAPFSDRWLKENAGAASGFFSRADEAGKLIWESDPNKNWWANRMDDIRGIVQGAVNPFLMGFQGVGIGAITDSAVSPVTDTAAQQTLQGINHLGNLSPEAQLAAATALQDSAFAVKDGINSARQWADAHPNITATAQTALAVAEAATTVWGGKKVELNPTKWDWVKNTGYKTPAVRTMHTLDGEMAGGNRPPKSITSNSKADASTQ

SEQ ID NO: 893 - DNA, 768 bp, Neisseria gonorrhoeae
atgttccaccataaaggtattgcccgaaaccggcggatggaggttttgtttttctgccgccgccctgatcgcttcgtgattcgccaaacgcgcctgttgcagcctcatttgcgcataatcctgctccaaggcgatttcctgttttttcgccttgtccaaagctgtgaagttgagcctgtactggttttgctgcatcacaacggaaaaagcggaaacgcacaccgcaagcagcagaaagaaattcgatttgttcattgccgttcagacgtttttctctgttattattccggtatcggaccggcagtccgctccgccacacgcaaaactgcgctcctcgccctcgggttggcggcaatttccgcttcacccggctttaatgccctgcccacgattttcaggggcggatcgggcaaatccgcttctctgaccgccgcccagctcggcaggggctcgtgttgcgaatattttttgacaaactgcttcacaatgcggtcttccaacgaatggaaagcaatgaccgccaaacgcccgccctctttcagacggcacatgacctgcggcaataccgcccctacttcttcaagctcgcggttaataaagatgcggattgcctggaaggtgcgcgtcgcaggatcctgcccccgctcgcgagtacggacgttttgtgccacgatctgcgccagcttgcgggttgtatcgattggactttccgcccgttgcgcgacaatggcgcgcacaatctggcggctaaaccgctcttcaccataa

SEQ ID NO: 894 - protein, 255 aa, Neisseria gonorrhoeae
MFHHKGIARNRRMEVLFFCRRPDRFVIRQTRLLQPHLRIILLQGDFLFFRLVQSCEVEPVLVLLHHNGKSGNAHRKQQKEIRFVHCRSDVFLCYYSGIGPAVRSATRKTALLALGLAAISASPGFNALPTIFRGGSGKSASLTAAQLGRGSCCEYFLTNCFTMRSSNEWKAMTAKRPPSFRRHMTCGNTAPTSSSSRLIKMRIAWKVRVAGSCPRSRVRTFCATICASLRVVSIGLSARCATMARTIWRLNRSSP

SEQ ID NO: 895 - DNA, 768 bp, Neisseria meningitidis
atgctccaccataaaggtmykgcccgaaaccggckgatggaggttttgtttttctgccgccgccctgatcgcttcgtggttcgccaaacgcgcctgttgcagcctcatttgcgcataatcctgctccaaggcgatttcctgttttttcgccttatccaaagctgtgaaattgagcctgtactggttttgctgcatcacaacggaaaaagcggaaacgcacaccgcaagcagcagaaggaaattcaatttgttcattgccattcagacgtttttctctgtgattgttccggtatcggaccggcagtccgctccgccacacgcaaaaccgcacttctcgccctcggattggcggcaatttccgcctcacccggctttaatgccctgcccacgattttcaggggcagctcgggcaaatccgcttccctgaccgccgcccagcgcggcaggggcgcgtgttgcgaatattttttgacaaactgcttcacaatgcgatcttccaacgaatggaaagcaatgaccgccaaacgtccgccctctttcagacgacacatgacctgcggcaatactgcccctacttcttcaagctcgcggttaataaagatgcggaccgcctggaaggtgcgcgtcgcaggatcctgcccccgctcgcgagtacggacgttttgtgccacgatctgcgccagcttgcgggttgtatcgattggactttccgcccgttgcgcaacaatggcgcgcgcaatccggcggctaaaccgctcttcaccataa

SEQ ID NO: 896 - protein, 255 aa, Neisseria meningitidis
  misc_feature (7)..(7): Xaa can be any naturally occurring amino acid
  misc_feature (12)..(12): Xaa can be any naturally occurring amino acid
MLHHKGXARNRXMEVLFFCRRPDRFVVRQTRLLQPHLRIILLQGDFLFFRLIQSCEIEPVLVLLHHNGKSGNAHRKQQKEIQFVHCHSDVFLCDCSGIGPAVRSATRKTALLALGLAAISASPGFNALPTIFRGSSGKSASLTAAQRGRGACCEYFLTNCFTMRSSNEWKAMTAKRPPSFRRHMTCGNTAPTSSSSRLIKMRTAWKVRVAGSCPRSRVRTFCATICASLRVVSIGLSARCATMARAIRRLNRSSP

SEQ ID NO: 897 - DNA, 768 bp, Neisseria meningitidis
atgctccaccataaaggtattgcccgaaaccggcggatggaggttttgtttttctgccgccgccctgatcgcttcgtggttcgccaaacgcgcctgttgcagcctcatttgcgcataatcctgctccaaggcgatttcctgttttttcgccttatccaaagctgtgaagttgagcctgtactggttttgctgcatcacaacggaaaaagcggaaacgcacaccgcaagcagcagaaggaaattcaatttgttcattgccattcagacgtttttctctgtgattgttccggtatcggaccggcagtccgctccgccacacgcaaaaccgcacttctcgccctcggattggcggcaatttccgcctcacccggctttaatgccctgcccgcgattttcaggggcggctcgggcaaatccgcttccctgaccgccgcccagcgcggcaggggcgcgtgttgcgaatattttttgacaaactgcttcacaatgcggtcttccaacgaatggaaagcaatgaccgccaaacgtccgccctctttcagacgacacatgacctgcggcaatactgcccctacttcttcaagctcgcggttaataaagatgcggattgcctggaaggtgcgcgtcgcaggatcctgcccccgctcgcgagtacggacgttttgtgccacgatctgcgccagcttgcgggttgtatcgattggactttccgcccgttgcgcaacaatggcgcgcgcaatctggcggctaaaccgctcttcaccataa

SEQ ID NO: 898 - protein, 255 aa, Neisseria meningitidis
MLHHKGIARNRRMEVLFFCRRPDRFVVRQTRLLQPHLRIILLQGDFLFFRLIQSCEVEPVLVLLHHNGKSGNAHRKQQKEIQFVHCHSDVFLCDCSGIGPAVRSATRKTALLALGLAAISASPGFNALPAIFRGGSGKSASLTAAQRGRGACCEYFLTNCFTMRSSNEWKAMTAKRPPSFRRHMTCGNTAPTSSSSRLIKMRIAWKVRVAGSCPRSRVRTFCATICASLRVVSIGLSARCATMARAIWRLNRSSP

SEQ ID NO: 899 - DNA, 663 bp, Neisseria gonorrhoeae
atgatagaagtcatacatttcttcggcgccgaaacgcgcagacagtttgcttgtgccgacgttggacgatttctgcataatgccgcgcacatccaaagaggggtaaacatgggtatcatcgcgcacgggagacggtccgattttataaggctgcgtattcagccgttcgttcaaatcggttttgcccgcatccaatgccttcgcaatcacgaacggtttgattgccgaaccaggttcgatcatatcggttacggcacggttgcgccgctgttcgctgtctgcccggccgggtctgttgggatcgtaggcgggcgtattggccaaggcgaggatttcccccgtgcgggcatccaaaaccaccaccgttccggcttttgcctgatggtattcgaccgccttgttcaactcttcataggccaaggtctgaatcctctgatcgagggaaaggatgatgtctttgccgttttgcggtgctttattgcgcggggagtccaagctgtccacaatattgccctgccggtcccgcaaaacaacttccgcgccgtcttcgccatacaggctgtcttcaagcgaaagttccaaaccttcctgacctttgccgtcaatatcggtaaatccgatgacgtgtgcaaacaggttgcccatcgggtaatggcgttttaa

SEQ ID NO: 900 - protein, 220 aa, Neisseria gonorrhoeae
MIEVIHFFGAETRRQFACADVGRFLHNAAHIQRGVNMGIIAHGRRSDFIRLRIQPFVQIGFARIQCLRNHERFDCRTRFDHIGYGTVAPLFAVCPAGSVGIVGGRIGQGEDFPRAGIQNHHRSGFCLMVFDRLVQLFIGQGLNPLIEGKDDVFAVLRCFIARGVQAVHNIALPVPQNNFRAVFAIQAVFKRKFQTFLTFAVNIGKSDDVCKQVAHRVMAF

SEQ ID NO: 901 - DNA, 660 bp, Neisseria meningitidis
atgatagaagtcatacatttcttcggcaccgaaacgcgcagacagtttgcttgtgccgacgttggacgatttctgcatgatgccgcgcacatccaaagaggggtaaacatgggtatcgcgcacgggagacggtccgattttataaggctgcgtattcagccgttcgttcaaatcggttttgcccgcatccaatgccttcgcaatcacaaacggtttgattgccgaaccgggttcgatcatatcggttacggcacggttgcgccgctgttcgctgtctgcccggccgggcctgttgggatcgtaggcgggcgtattggccaaggcgaggatttcccccgtgcgggcatccaaraccaccaccgttccggcttttgcctgatggtattcgaccgccttgttcaactcttcataggccaaggtctgaatcctctgatcgagggaaaggatgatgtctttgccgtttttcggggctttaktgcgcggggagtccaagctgtccacaatattgccctgccggtcccgcaaaacgacttccgcgccgtcttcgccatgcaagctgtcttcaagcgaaagttccaaaccttcctgacctttgccgtcaatatcggtaaatccgatgacgtgtgcaaacaggttgcccatcgggtaatggcgttttaa

SEQ ID NO: 902 - protein, 219 aa, Neisseria meningitidis
  misc_feature (118)..(118): Xaa can be any naturally occurring amino acid
  misc_feature (159)..(159): Xaa can be any naturally occurring amino acid
MIEVIHFFGTETRRQFACADVGRFLHDAAHIQRGVNMGIAHGRRSDFIRLRIQPFVQIGFARIQCLRNHKRFDCRTGFDHIGYGTVAPLFAVCPAGPVGIVGGRIGQGEDFPRAGIQXHHRSGFCLMVFDRLVQLFIGQGLNPLIEGKDDVFAVFRGFXARGVQAVHNIALPVPQNDFRAVFAMQAVFKRKFQTFLTFAVNIGKSDDVCKQVAHRVMAF

SEQ ID NO: 903 - DNA, 660 bp, Neisseria meningitidis
atgatagaagtcatacatttcttcggcaccgaaacgcgcagacagtttgcttgtgccgacgttggacgatttctgcatgatgccgcgcacatccaaagaggggtaaacatgggtatcgcgcacgggagacggtccgattttataaggctgcgtattcagccgttcgttcaaatcggttttgcccgcatccaatgccttcgcaatcacaaacggtttgattgccgaaccgggttcgatcatatcggttacggcacggttgcgccgctgttcgctgtctgcccggccgggcctgttgggatcgtaggcgggcgtattggccaaggcgaggatttcccccgtgcgggcatccaaaaccaccaccgttccggcttttgcctgatggtattcgaccgccttgttcaactcttcataggccaaggtctgaatcctctgatcgagggaaaggatgatgtctttgccgtttttcggggctttattgcgcggggagtccaagctgtccacaatattgccctgccggtcccgcaaaacgacttccgcgccgtcttcgccatgcaggctgtcttcaagcgaaagttccaaaccttcctgacctttgccgtcaatatcggtaaatccgatgacgtgtgcaaacaggttgcccatcgggtaatggcgttttaa

SEQ ID NO: 904 - protein, 219 aa, Neisseria meningitidis
MIEVIHFFGTETRRQFACADVGRFLHDAAHIQRGVNMGIAHGRRSDFIRLRIQPFVQIGFARIQCLRNHKRFDCRTGFDHIGYGTVAPLFAVCPAGPVGIVGGRIGQGEDFPRAGIQNHHRSGFCLMVFDRLVQLFIGQGLNPLIEGKDDVFAVFRGFIARGVQAVHNIALPVPQNDFRAVFAMQAVFKRKFQTFLTFAVNIGKSDDVCKQVAHRVMAF

SEQ ID NO: 905 - DNA, 660 bp, Neisseria gonorrhoeae; identical to SEQ ID NO: 901

SEQ ID NO: 906 - protein, 267 aa, Neisseria gonorrhoeae
MPTRPTRAANPPTPTTWLQTAYCPRPPYRPPSVQTHTPHEPASSTCAAKSANRRENSHNAQPTYLLHPSNKMPSETEQTLFRRHQIPPSCRQSVVVMTVRTVDMTVCDFLIGCIAHAFNRSFKADFHACQRMVAVHHRLAVGNIGYTIDDNIAGFRIVRFKHHTDLDFNRERARIFNTDQLRIMLTERIVGRKRHFDRIAGILTVQRLFHQRENAVVTAVQIRNRFFGFIQKLIVGIIHLIMQRNHGIFCNSHICPFRNSRLITGAF

SEQ ID NO: 907 - DNA, 534 bp, Neisseria meningitidis
cggcaatcagtggtggtgatgaccgtgcgggccgtggacatgaccgtgtgcgatttcctcatcggatgcatcgcgcacgctttcaactgtagccttaaagcggattttcatgcctgccaaaggatggttgccgtccaccaccgccttgccgtcggcaacatcggttacacgatagacgacaacatcgccggtttcaggatcgtcggcttcaaacatcatgccgacttcgacttcaacagggaacacgcccgcatcttcgatacggaccaactccggatcctgctcgccgaacgcatcgtcgggcgacagcgccacatcgaccgtatcgccggcatccttaccgtgcaacgcctcttccaccaaagggaaaatgccgtcgtaaccgccgtgcagatacgcaatcggttcttcggttttgtccaaaagctgattgttggcatcatacatctcataatgcagcgaaaccacggaatttttcacgatagccatatttgtcctttcaggaacagcagattaattacaggcgcattctaa

SEQ ID NO: 908 - protein, 177 aa, Neisseria meningitidis
RQSVVVMTVRAVDMTVCDFLIGCIAHAFNCSLKADFHACQRMVAVHHRLAVGNIGYTIDDNIAGFRIVGFKHHADFDFNREHARIFDTDQLRILLAERIVGRQRHIDRIAGILTVQRLFHQRENAVVTAVQIRNRFFGFVQKLIVGIIHLIMQRNHGIFHDSHICPFRNSRLITGAF

SEQ ID NO: 909 - DNA, 804 bp, Neisseria meningitidis
atgccaacacgtccaactcgcgccgcaaagcatccaaccccgccaacctggcttcagacggcatactgccctcgtccgccatatcgtccgccgtccgtgcaaacgcatacaccgcatgaaccggcttcctcaacctgcgcggcaaaatcagcgaaccgacgggaaaattttcataatgcccaaccgacataccttctccatccatcaaacaaaatgccgtctgaaatggaacaaacccttttcagacggcatcagatacctccaagctgccggcaatcagtggtggtgatgaccgtgcggaccgtggacatgaccgtgtgcgatttcctcatcggatgcatcgcgcacactttcaaccgtagccttaaagcggattttcatgcctgccaaaggatggttgccgtccaccaccgccttaccgtcggcaacatcggttacacgatagacgacaacatcgccggtttcaggatcgtcggcttcaaacatcatgccgacttcgacttcaacagggaacacgcccgcatcttcaatacggaccaactccggatcctgctcgccgaacgcatcgtcgggcgaaagcgccacatcgaccgtatcgccggcatccttaccgtgcaacgcctcttccaccaaagggaaaatgccgtcgtaaccgccgtgcagatacgcaatcggttcttcggttttgtccaaaagctgattgttggcatcatacatctcataatgcagcgaaaccacggaattcttcacgatagccatatttgtcctttcaggaacagcagattaattacaggcgcattctaa

SEQ ID NO: 910 - protein, 267 aa, Neisseria gonorrhoeae
MPTRPTRAAKHPTPPTWLQTAYCPRPPYRPPSVQTHTPHEPASSTCAAKSANRRENFHNAQPTYLLHPSNKMPSEMEQTLFRRHQIPPSCRQSVVVMTVRTVDMTVCDFLIGCIAHTFNRSLKADFHACQRMVAVHHRLTVGNIGYTIDDNIAGFRIVGFKHHADFDFNREHARIFNTDQLRILLAERIVGRKRHIDRIAGILTVQRLFHQRENAVVTAVQIRNRFFGFVQKLIVGIIHLIMQRNHGILHDSHICPFRNSRLITGAF

SEQ ID NO: 911 - DNA, 660 bp, Neisseria gonorrhoeae; identical to SEQ ID NO: 901

SEQ ID NO: 912 - protein, 267 aa, Neisseria gonorrhoeae; identical to SEQ ID NO: 906

SEQ ID NO: 913 - DNA, 804 bp, Neisseria meningitidis
atgccaacacgtccaactcgcgctgcaaaccctccaaccccgccaacctggcttcagacggcatactgccctcgtccgccatatcgtccgccgtccgtgcaaacgcgtacaccgcgtgaaccggcttcctcaacctgcgcggcaaaatcagcgaaccgacgggaaaattctcataatgcccaaccgacataccttctccatccatcaaacaaaatgccgtctgaaacggaacaaacccttttcagacggcatcagatacctccaagctgccggcaatcagtggtggtgatgaccgtgcgggccgtggacatgaccgtgtgcgatttcctcatcggatgcatcgcgcacgctttcaactgtagccttaaagcggattttcatgcctgccaaaggatggttgccgtccaccaccgccttgccgtcggcaacatcggttacacgatagacgacaacatcgccggtttcaggatcgtcggcttcaaacatcatgccgacttcgacttcaacagggaacacgcccgcatcttcgatacggaccaactccggatcctgctcgccgaacgcatcgtcgggcgacagcgccacatcgaccgtatcgccggcatccttaccgtgcaacgcctcttccaccaaagggaaaatgccgtcgtaaccgccgtgcagatacgcaatcggttcttcggttttgtccaaaagctgattgttggcatcatacatctcataatgcagcgaaaccacggaatttttcacgatagccatatttgtcctttcaggaacagcagattaattacaggcgcattctaa

SEQ ID NO: 914 - protein, 267 aa, Neisseria meningitidis
MPTRPTRAANPPTPPTWLQTAYCPRPPYRPPSVQTRTPREPASSTCAAKSANRRENSHNAQPTYLLHPSNKMPSETEQTLFRRHQIPPSCRQSVVVMTVRAVDMTVCDFLIGCIAHAFNCSLKADFHACQRMVAVHHRLAVGNIGYTIDDNIAGFRIVGFKHHADFDFNREHARIFDTDQLRILLAERIVGRQRHIDRIAGILTVQRLFHQRENAVVTAVQIRNRFFGFVQKLIVGIIHLIMQRNHGIFHDSHICPFRNSRLITGAF

SEQ ID NO: 915 - DNA, 804 bp, Neisseria meningitidis; identical to SEQ ID NO: 909

SEQ ID NO: 916 - protein, 267 aa, Neisseria meningitidis; identical to SEQ ID NO: 910

SEQ ID NO: 917 - DNA, 870 bp, Neisseria gonorrhoeae
atgatcggcgaacttgttgttttgttcgtgatcgagcacttcaagcaacgcgctggcgggatcgccccgaaagtcgctgcccaatttgtcgatttcgtcgagcaggaacaacgggtttcttacgcctgcttttgccatattctgcaaaatcttgccgggcatagagccgatataggtacggcggtgcccgcggatttcgctttcgtcgcgcacgccgcccaaggccatacggacatatttccgccccgttgctttggcgatggattcgcccaaagaggttttgcccacgcccggagggccgaccaaacacagaatcggacctttgagcttgtccatacgtttttggacggcgaggtattccaaaatccgttctttgactttttccaggccgtagtggtcggcatccagcaccagtccggctttggcgatgtctttgctgacgcgggattttttcttccacggcagtccgagcagggtgtcgatgtagttgcgtacgacggtggattcggcagacatcggcggcatcattttgagttttttcagttcggacaggcatttttcttccgcttctttggtcatacccgcctttttgatgcctgcctccaaggcatccagttcgccgttttcgtcttcttcgcccaattctttgtgtatcgctttaatctgttcgttcagataatattcgcgttgggatttttccatttggcgtttgacgcgtccgcgtatgcgtttttcggcctgcataatgtcgagttcggattccagctttgccagcaggaattccatccgtttgccgatttcgggaatctccaaaatctgttggcgttgcgccagtttcaactgcaaatgcgctgcgaccgtatcggttag

SEQ ID NO: 918 - protein, 289 aa, Neisseria gonorrhoeae
MIGELVVLFVIEHFKQRAGGIAPKVAAQFVDFVEQEQRVSYACFCHILQNLAGHRADIGTAVPADFAFVAHAAQGHTDIFPPRCFGDGFAQRGFAHARRADQTQNRTFELVHTFLDGEVFQNPFFDFFQAVVVGIQHQSGFGDVFADAGFFLPRQSEQGVDVVAYDGGFGRHRRHHFEFFQFGQAFFFRFFGHTRLFDACLQGIQFAVFVFFAQFFVYRFNLFVQIIFALGFFHLAFDASAYAFFGLHNVEFGFQLCQQEFHPFADFGNLQNLLALRQFQLQMRCDRIG

SEQ ID NO: 919 - DNA, 870 bp, Neisseria meningitidis
atgatcggcaaacttgttgttttgttcgggatcgagcacttcgagcaacgcgctggcgggatcgcctcggaagtcgttacccaatttgtcgatttcgtcgagcaggaacaaggggtttttcacgccggcttttgccatattctgcaaaatcttaccgggcatagagccgatataggtgcggcggtgtcccctgatttcgctttcgtcgcgcacgccgcccaaagccatgcggacatatttccgccccgttgctttggcgatggattcgcccaaagaggttttgcccacgcccggagggccgaccaggcacagaatcgggcctttgagtttgtccatacgtttttggacggcgaggtattccaaaatccgttctttgactttttccaggccgtagtggtcggcatccagcaccagtccggctttggcgatgtctttgctgacgcgggattttttcttccacggcagctcgagcaaagtgtcgatgtagttgcgtacgacggtggattccgcagacatcggtggcatcattttgagctttttcagttcggacaggcatttttcttccgcttctttggtcatacccgcctttttgatatctgcttccaaggcatccagttcgccgttttcgtcttcttcgcccagttctttgtgtatcgctttaatctgttcgttcagataatattcgcgctgggatttttccatttggcgtttgacgcgtccgcgtatgcgtttttcggcctgcataatgtcgagttcggattccagctgtgccagcaggaattccatccgtttgccgatttcgggaatttccaaaatctgttggcgttgcgccagtttcaactgcaaatgcgctgcgaccgtatcggttag

SEQ ID NO: 920 - protein, 289 aa, Neisseria meningitidis
MIGKLVVLFGIEHFEQRAGGIASEVVTQFVDFVEQEQGVFHAGFCHILQNLTGHRADIGAAVSPDFAFVAHAAQSHADIFPPRCFGDGFAQRGFAHARRADQAQNRAFEFVHTFLDGEVFQNPFFDFFQAVVVGIQHQSGFGDVFADAGFFLPRQLEQSVDVVAYDGGFRRHRWHHFELFQFGQAFFFRFFGHTRLFDICFQGIQFAVFVFFAQFFVYRFNLFVQIIFALGFFHLAFDASAYAFFGLHNVEFGFQLCQQEFHPFADFGNFQNLLALRQFQLQMRCDRIG

SEQ ID NO: 921 - DNA, 870 bp, Neisseria meningitidis
  misc_feature (80)..(80): n is a, c, g, or t
atgatcggcgaacttgttgttttgctcgggatcaagcacttcgagcaacgcgctggcgggatcgccccggaagtcgctanccaatttgtcgatttcgtcgagcaggaacaatgggttttttacgccggcttttgccatattctgcaaaatcttaccgggcatggagccgatataggtgcggcggtgtccccggatttcgctttcgtcgcgcacgccgcccaaagccatgcggacatatttccgccccgttgctttggcgatggattcgcccaaagaggttttgcccacgcctggagggccgaccaggcacagaatcgggcctttgagtttgtccatacgtttttggacggcgaggtattccaaaatccgttctttgactttttccaggccgtagtggtcggtatccagcaccaatccggctttggcgatgtctttgctgacgcgggattttttcttccacggcagttcgagcagggtgtcgatgtagttgcgtacgacggtggattcggcagacatcggcggcatcattttgagctttttcagttcggacaggcatttttcttccgcttctttggtcatacccgcctttttgatatctgcttccaaggcatccagttcgccgttttcgtcttcttcgcccagttctttgtgtatcgctttaatctgttcgttcagataatattcgcgctgggatttttccatttggcgtttgacgcgtccgcgtatgcgtttttcggcctgcataatgtcgagttcggattccagctgtgccagcaggaattccatccgtttgccgatttcgggaatttccaaaatctgttggcgttgcgccagtttcaactgcaaatgcgctgcgaccgtatcggttag

SEQ ID NO: 922 - protein, 289 aa, Neisseria meningitidis
  misc_feature (27)..(27): Xaa can be any naturally occurring amino acid
MIGELVVLLGIKHFEQRAGGIAPEVAXQFVDFVEQEQWVFYAGFCHILQNLTGHGADIGAAVSPDFAFVAHAAQSHADIFPPRCFGDGFAQRGFAHAWRADQAQNRAFEFVHTFLDGEVFQNPFFDFFQAVVVGIQHQSGFGDVFADAGFFLPRQFEQGVDVVAYDGGFGRHRRHHFELFQFGQAFFFRFFGHTRLFDICFQGIQFAVFVFFAQFFVYRFNLFVQIIFALGFFHLAFDASAYAFFGLHNVEFGFQLCQQEFHPFADFGNFQNLLALRQFQLQMRCDRIG

SEQ ID NO: 923 - DNA, 333 bp, Neisseria gonorrhoeae
atggtaatcgtctggttgcccgagttaccgccgatgccggcgacgatgggcatcagcgcggcgagtgcgacgattttttcgatactgccttcaaacgcgccgatgacgcggctggcgaggaaggcggtgcagaggttgacggcgagccacatccagcggtttttgacggaatccaagacgggggcgaacaggtcttcctcttcctgcaaacctgccatgttcaacatatccgcttcggattcttcgcggatcacgtccaccatctcgtcgatggtaatcctgccgatgagctttttgttttcatcaacgacgggcgcggtaaccaagtcgtag

SEQ ID NO: 924 - protein, 110 aa, Neisseria gonorrhoeae
MVIVWLPELPPMPATMGISAASATIFSILPSNAPMTRLARKAVQRLTASHIQRFLTESKTGANRSSSSCKPAMFNISASDSSRITSTISSMVILPMSFLFSSTTGAVTKS

SEQ ID NO: 925 - DNA, 333 bp, Neisseria meningitidis
atggtaatcgtctggttgcccgagttaccgcctatgccggcgacgatgggcatcagcgcggygagtgcgacgattttttcgatgctgccttcaaacgcgccgataacacggytggcgaggaaggcggtgcagaggttgacggcgagccacatccagyggtttttcaccgaatcccacacgggggcgaayaggtcttcctcttcctgcaaacccgccatattcagcatatccgcttccgattcttcgcggatcacgtccaccatctcgtcgatggtaatcctgccgatgagctttttgttttcatcgacgacgggcgcggtaaccaagtcgtag

SEQ ID NO: 926 - protein, 110 aa, Neisseria meningitidis
  misc_feature (21)..(21): Xaa can be any naturally occurring amino acid
  misc_feature (53)..(53): Xaa can be any naturally occurring amino acid
MVIVWLPELPPMPATMGISAXSATIFSMLPSNAPITRLARKAVQRLTASHIQXFFTESHTGANRSSSSCKPAIFSISASDSSRITSTISSMVILPMSFLFSSTTGAVTKS

SEQ ID NO: 927 - DNA, 333 bp, Neisseria meningitidis
atggtaatcgtctggttgcccgagttaccgcctatgccggcgacgatgggcatcagcgcggcgagtgcgacgattttttcgatgctgccttcaaacgcgccgataacacggctggcgaggaaggcggtgcagaggttgacggcgagccacatccagcggtttttgacggaatccaagacgggggcgaataagtcttcctcttcttgcaaacccgccatattcaacatatccgcttcggattcttcgcggatcacgtccaccatttcgtcaacggtcaccctgccgatgagctttttgttttcatcgacgacgggcgcggtaaccaagtcatag

SEQ ID NO: 928 - protein, 110 aa, Neisseria meningitidis
MVIVWLPELPPMPATMGISAASATIFSMLPSNAPITRLARKAVQRLTASHIQRFLTESKTGANKSSSSCKPAIFNISASDSSRITSTISSTVTLPMSFLFSSTTGAVTKS

SEQ ID NO: 929 - DNA, 834 bp, Neisseria gonorrhoeae
atgccgcctgaagcccggccggcgggttcagacggcattgccgctttacttcgatcggtttatacgcaaaacgcgcttcaggaaataaatcagattattccccagacgccttcaggcttccttccgtgccaccgtaaccatagccgggcgcaacacacggtcggacagggtataacccttcttcatcacaccaaccacggtattgggttcctgctcactggccaccgcctgcatcgcctgatggatattcggatcgagcttatcgcccgctttaggattgatttccttgatttgcgtggcatcaaacgccttctgcaactcattcaaagtcatctgcacacccattttcagcgcatcgaaattaccgctctgatccaaaagcgccatttccagataatccttgaccggcaacatttccacggcaaacttctgtccggcgaacttgtgcgtatcggcaatttcctgctggtggcggcggcgcaggttttgctcgtttgccaaagcgcgcagttgttcgtctttcaactgcgcttccagctcggcaatccgcgcctgcaaatcctcataagccggctcggcggcagcctgttcctgtacaccgtccgcatttcctactgtctcgacggtttccaccgcctccacattttcaaccgcttcttcactgttttgctgctgtgtctgttcgctcatatcgtatccctcaaaacaaattggaaatcaaaatccggttattacccgagcaagataaggacattttcaagaaacttcaagcaaaggcaggaaatttcacatccgccgccgaataccctaccgcaaaaaccatataaacggtaa

SEQ ID NO: 930 - protein, 277 aa, Neisseria gonorrhoeae
MPPEARPAGSDGIAALLRSVYTQNALQEINQIIPQTPSGFLPCHRNHSRAQHTVGQGITLLHHTNHGIGFLLTGHRLHRLMDIRIELIARFRIDFLDLRGIKRLLQLIQSHLHTHFQRIEITALIQKRHFQIILDRQHFHGKLLSGELVRIGNFLLVAAAQVLLVCQSAQLFVFQLRFQLGNPRLQILISRLGGSLFLYTVRISYCLDGFHRLHIFNRFFTVLLLCLFAHIVSLKTNWKSKSGYYPSKIRTFSRNFKQRQEISHPPPNTLPQKPYKR

SEQ ID NO: 931 - DNA, 831 bp, Neisseria meningitidis
atgccgtctgaagcccgacaggcgggttcagacggcattgccgctttacttcgatcggtttatacgcaaaacgcgcttcaggaaataaatcagattattccccagacgccttcaggcttccttctgcgccaccgtaaccatagccgggcgcaacacgcggtcggacagcgtataacccttcttcatcacacccaccacggtattcggctcctgttcgcttgccaccgcctgcatcgcctgatggatattcggatcgagcttatcgcccgctttagggttgatttccttgatttgcgtagcatcaaatgctttctgcaactcgttcaaagtcatctgcacgcccattttcagcgcatcgaaattgccgctctgatccaaaagcgccatttccagataatccttgaccggcagcatttccacggcaaacttctgtccggcgaacttgtgcgtatccgcaatttyctgctggtggcggcggcgcaggttttgctcgtttgccaaagcgcgctgctcgtctttcaactgcgtttccagctcggcaatccgcgcctgcaaatcctcataagccggctctgcggcagcctgttcctgcacaccgtccgcatttcctactgtttcgacggtttccaccgcctccacattttcaaccgcttcttcactgttttgctgctgtgtctgttcgctcatatcgtatcccttaaaacaaattggaaatcaaaatccagttattacccgcgcaagataaggacattttcaagaaacttcaakcaaaakcagagaatttcaaattcattttcaaatcccctaccgaaaaaataatatagacggtaa

SEQ ID NO: 932 - protein, 276 aa, Neisseria meningitidis
  misc_feature (256)..(256): Xaa can be any naturally occurring amino acid
  misc_feature (258)..(258): Xaa can be any naturally occurring amino acid
  misc_feature (273)..(273): Xaa can be any naturally occurring amino acid
MPSEARQAGSDGIAALLRSVYTQNALQEINQIIPQTPSGFLLRHRNHSRAQHAVGQRITLLHHTHHGIRLLFACHRLHRLMDIRIELIARFRVDFLDLRSIKCFLQLVQSHLHAHFQRIEIAALIQKRHFQIILDRQHFHGKLLSGELVRIRNFLLVAAAQVLLVCQSALLVFQLRFQLGNPRLQILISRLCGSLFLHTVRISYCFDGFHRLHIFNRFFTVLLLCLFAHIVSLKTNWKSKSSYYPRKIRTFSRNFXQXQRISNSFSNPLPKKXYRR

SEQ ID NO: 933 - DNA, 834 bp, Neisseria meningitidis
atgccgtctgaagcccgacaggcgggttcagacggcattgccgctttacttcgatcggtttatacgcaaaacgcgcttcaggaaataaatcagattattccccagacgccttcaggcttccttctgtgccaccgtaaccatagccgggcgcaacacgcggtcggacagcgtataacccttcttcatcacgcccaccacggtattgggttcctgttcgcttgccaccgcctgcatcgcctgatggatattcggatcgagcttatcgcccgctttaggattgatttccttgatttgcgtagcatcaaatgctttctgcaactcgttcaaagtcatctgcacgcccattttcagcgcatcgaaattgccgctctgatccaaaagcgccatttccagataatccttgaccggcagcatttccacggcaaacttctgtccggcgaacttgtgcgtatccgcaatttcctgctggtggcggcggcgcaggttttgctcgtttgccaaagcgcgcagctgctcgtctttcaactgcgcttccagctcggcaatccgcgcctgcaaatcctcataagccggctctgcggcagcctgttcctgcacaccgtccgcatttcctactgtctcgacggtttccaccgcctccacattttcaaccgcttcttcactgttttgctgctgtgtctgttcgctcatatcgtatcccttaaaacaaattggaaatcaaaatccagttattacccgcgcaagataaggacattttcaagaaacttcaagcaaaggcagagaatttcaaattcattttcaaatcccctaccgaaaaaataatatagacggtaa

SEQ ID NO: 934 - protein, 276 aa, Neisseria meningitidis
MPSEARQAGSDGIAALLRSVYTQNALQEINQIIPQTPSGFLLCHRNHSRAQHAVGQRITLLHHAHHGIGFLFACHRLHRLMDIRIELIARFRIDFLDLRSIKCFLQLVQSHLHAHFQRIEIAALIQKRHFQIILDRQHFHGKLLSGELVRIRNFLLVAAAQVLLVCQSAQLLVFQLRFQLGNPRLQILISRLCGSLFLHTVRISYCLDGFHRLHIFNRFFTVLLLCLFAHIVSLKTNWKSKSSYYPRKIRTFSRNFKQRQRISNSFSNPLPKKYRR

SEQ ID NO: 935 - DNA, 834 bp, Neisseria gonorrhoeae; identical to SEQ ID NO: 929

SEQ ID NO: 936 - protein, 277 aa, Neisseria gonorrhoeae; identical to SEQ ID NO: 930

SEQ ID NO: 937 - DNA, 819 bp, Neisseria meningitidis
atgccgtctgaagcccgacaggcgggttcagacggcattgccgctttacttcgatcggtttatacgcaaaacgcgcttcaggaaataaatcagattattccccagacgccttcaggcttccttctgcgccaccgtaaccatagccgggcgcaacacgcggtcggacagcgtataacccttcttcatcacacccaccacggtattcggctcctgttcgcttgccaccgcctgcatcgcctgatggatattcggatcgagcttatcgcccgctttagggttgatttccttgatttgcgtagcatcaaatgctttctgcaactcgttcaaagtcatctgcacgcccattttcagcgcatcgaaattgccgctctgatccaaaagcgccatttccagataatccttgaccggcagcatttccacggcaaacttctgtccggcgaacttgtgcgtatccgcaatttyctgctggtggcggcggcgcaggttttgctcgtttgccaaagcgcgctgctcgtctttcaactgcgtttccagctcggcaatccgcgcctgcaaatcctcataagccggctctgcggcagcctgttcctgcacaccgtccgcatttcctactgtttcgacggtttccaccgcctccacattttcaaccgcttcttcactgttttgctgctgtgtctgttcgctcatatcgtatcccttaaaacaaattggaaatcaaaatccagttattacccgcgcaagataaggacattttcaagaaacttcaakcaaaakcagagaatttcaaattcattttcaaatcccctaccgaaaaaataa

SEQ ID NO: 938 - protein, 272 aa, Neisseria meningitidis
  misc_feature (256)..(256): Xaa can be any naturally occurring amino acid
  misc_feature (258)..(258): Xaa can be any naturally occurring amino acid
MPSEARQAGSDGIAALLRSVYTQNALQEINQIIPQTPSGFLLRHRNHSRAQHAVGQRITLLHHTHHGIRLLFACHRLHRLMDIRIELIARFRVDFLDLRSIKCFLQLVQSHLHAHFQRIEIAALIQKRHFQIILDRQHFHGKLLSGELVRIRNFLLVAAAQVLLVCQSALLVFQLRFQLGNPRLQILISRLCGSLFLHTVRISYCFDGFHRLHIFNRFFTVLLLCLFAHIVSLKTNWKSKSSYYPRKIRTFSRNFXQXQRISNSFSNPLPKK

SEQ ID NO: 939 - DNA, 822 bp, Neisseria meningitidis
atgccgtctgaagcccgacaggcgggttcagacggcattgccgctttacttcgatcggtttatacgcaaaacgcgcttcaggaaataaatcagattattccccagacgccttcaggcttccttctgtgccaccgtaaccatagccgggcgcaacacgcggtcggacagcgtataacccttcttcatcacgcccaccacggtattgggttcctgttcgcttgccaccgcctgcatcgcctgatggatattcggatcgagcttatcgcccgctttaggattgatttccttgatttgcgtagcatcaaatgctttctgcaactcgttcaaagtcatctgcacgcccattttcagcgcatcgaaattgccgctctgatccaaaagcgccatttccagataatccttgaccggcagcatttccacggcaaacttctgtccggcgaacttgtgcgtatccgcaatttcctgctggtggcggcggcgcaggttttgctcgtttgccaaagcgcgcagctgctcgtctttcaactgcgcttccagctcggcaatccgcgcctgcaaatcctcataagccggctctgcggcagcctgttcctgcacaccgtccgcatttcctactgtctcgacggtttccaccgcctccacattttcaaccgcttcttcactgttttgctgctgtgtctgttcgctcatatcgtatcccttaaaacaaattggaaatcaaaatccagttattacccgcgcaagataaggacattttcaagaaacttcaagcaaaggcagagaatttcaaattcattttcaaatcccctaccgaaaaaataa

SEQ ID NO: 940 - protein, 273 aa, Neisseria meningitidis
MPSEARQAGSDGIAALLRSVYTQNALQEINQIIPQTPSGFLLCHRNHSRAQHAVGQRITLLHHAHHGIGFLFACHRLHRLMDIRIELIARFRIDFLDLRSIKCFLQLVQSHLHAHFQRIEIAALIQKRHFQIILDRQHFHGKLLSGELVRIRNFLLVAAAQVLLVCQSAQLLVFQLRFQLGNPRLQILISRLCGSLFLHTVRISYCLDGFHRLHIFNRFFTVLLLCLFAHIVSLKTNWKSKSSYYPRKIRTFSRNFKQRQRISNSFSNPLPKK

SEQ ID NO: 941 - DNA, 510 bp, Neisseria gonorrhoeae
atgtacgggcggaacggtagtactcaagcggccgttgccttcgttttcgaccagacacagcgtgcccgtttcggcaacggcgaagtttacgccgctcaagccgacatcggcagtgctgtaaatatcgcgcagggctttgcgggcgaatccggtcagttggtccacgtcgtctgtaagcggtgtgccgaggttttggtggaacagttcgctgacctgttctttggttttatggattgcgggcatcacgatatgggtcggtttttcgcctgccatttggacgataaactcgcccaagtcgctttccaccgccttaatgccttttgcttcaagataatggttcagctcgatttcttcgctgaccatggatttgcctttgaccatcagcttgccgtttttggctgtgatgatgtcgtggataatttggcaggcttcggcaggggtttccgcccagtgtactttcacgcccaacttagtcaggttttcttccaactgctccagcagcgcgggtaa

SEQ ID NO: 942 - protein, 169 aa, Neisseria gonorrhoeae
MYGRNGSTQAAVAFVFDQTQRARFGNGEVYAAQADIGSAVNIAQGFAGESGQLVHVVCKRCAEVLVEQFADLFFGFMDCGHHDMGRFFACHLDDKLAQVAFHRLNAFCFKIMVQLDFFADHGFAFDHQLAVFGCDDVVDNLAGFGRGFRPVYFHAQLSQVFFQLLQQRG

SEQ ID NO: 943 - DNA, 449 bp, Neisseria meningitidis
atgcacgggcggtacggtggtactcaagcgaccgttgcttcgttttccaccagacacagcgtacctgtttcagcaacggcaaagtttacgccactcaaaccgacatcggcagtgctgtaaatatcgcgcagtgctttacgggcgaagccggtcagttggtctacatcgtctgtcagcggcgtaccgaggttttggtggaacagttcgctaacctgttctttggttttgtggatagcaggcatcacgatatgggtcggtttttcgcctgccatttggacgatgaactcgcccaagtcgctttctaccgctttaatgcyttttgcttcaagataatgrttcagctcgatttcctcgctgaccatcgatttgcctttgaccatcagcttgccgtttttggctgtgatgatgtcgtggataatttggcaggcttcggtcggggtttctgcccg

SEQ ID NO: 944 - protein, 150 aa, Neisseria meningitidis
  misc_feature (113)..(113): Xaa can be any naturally occurring amino acid
MHGRYGGTQATVAFVFHQTQRTCFSNGKVYATQTDIGSAVNIAQCFTGEAGQLVYIVCQRRTEVLVEQFANLFFGFVDSRHHDMGRFFACHLDDELAQVAFYRFNAFCFKIMXQLDFLADHRFAFDHQLAVFGCDDVVDNLAGFGRGFCP

SEQ ID NO: 945 - DNA, 501 bp, Neisseria meningitidis
atgcacgggcggaacggtggtactcaagcgaccgttgccttcgttttccaccagacacagcgtacctgtttcagcaacggcgaagttcacgccactcaaaccgacatcggcagtgctgtaaatatcgcgcagtgctttacgggcgaagccggtcagttggtctacgtcgtccgttaacggtgtgccgaggttttggtggaacagttcgctaacctgttctttggttttatggattgcgggcatcacgatatgggtcggtttttcacctgccatttggacgatgaactcgcccaagtcgctttccaccgctttaatgccttttgcttcaagataatggttcagctcgatttcctcgctgaccatcgatttgcctttgaccatcagcttgccgtttttggctgtgatgatgtcgtggatgatttcgcaggcttcggccggtgtttccgcccagtgtacttttacgcccaacttggtcaggttttcttccagctgctccagcag

SEQ ID NO: 946 - protein, 166 aa, Neisseria meningitidis
MHGRNGGTQATVAFVFHQTQRTCFSNGEVHATQTDIGSAVNIAQCFTGEAGQLVYVVRRCAEVLVEQFANLFFGFMDCGHHDMGRFFTCHLDDELAQVAFHRFNAFCFKIMVQLDFLADHRFAFDHQLAVFGCDDVVDDFAGFGRCFRPVYFYAQLGQVFFQLLQQ

SEQ ID NO: 947 - DNA, 981 bp, Neisseria gonorrhoeae
atgaaacgtaaaatgctaaacgtaccaaagggcggttatgatggtatgaagggttttaccattgttgaatttctggttgcgggcctgctcagtataattgtcctgatagcggtcgtatcgagttactttacatcccggaaattaaatgatgtggcaaacgagcgtcttgccattcaacaggatttgcggaatgcggcaacattaattgtccgcgatgcaagaatggcggggagcttcggttgtttcaatatgtccgagcatactaaagacgatattgttgattcaagtaatcaaactcaatctaaccttgcaaaacccggtgccaaacaagaaaatccccttttttccttaaaaaggagcggcatggataaacaactgattcccgttgctgaatccatagatattaaatatccgggttttatccagcgccttaacgcattggttttccaatacggtatcgatgatcttgatgcgagtgctgagactgttgtagtcagcagctgttccaaaatagcaaaaccgggtaagaaaatatctaccttgcaagaagcaaagagtgcattacagattactaatgatgataaacaaaatggaaatatcacccgtcagaaacatgtggtcaatgcctatgcggtcggcaggtttggcaataatgaggaaagtttgttccgcttccaattggatgataagggcaagtggggtaatcctcagttgctcgtgaaaaaggttaaacgtatggatgtgcggtatatttatgtttccggttgtcctgaagatgaagatgccggcaaagaggaaaaattcagatatacgaataaattcgacaaatccaaaaatgctgttacgcctgccggggtggaggttttattggatagcggccttaatgccaagattgccgcttcttcagacaatagtatttatgcttaccgtatcaatgcgacaatacgcgggggaaatgtatgcgcaaacagaacactttga

SEQ ID NO: 948 - protein, 326 aa, Neisseria gonorrhoeae
MKRKMLNVPKGGYDGMKGFTIVEFLVAGLLSIIVLIAVVSSYFTSRKLNDVANERLAIQQDLRNAATLIVRDARMAGSFGCFNMSEHTKDDIVDSSNQTQSNLAKPGAKQENPLFSLKRSGMDKQLIPVAESIDIKYPGFIQRLNALVFQYGIDDLDASAETVVVSSCSKIAKPGKKISTLQEAKSALQITNDDKQNGNITRQKHVVNAYAVGRFGNNEESLFRFQLDDKGKWGNPQLLVKKVKRMDVRYIYVSGCPEDEDAGKEEKFRYTNKFDKSKNAVTPAGVEVLLDSGLNAKIAASSDNSIYAYRINATIRGGNVCANRTL

SEQ ID NO: 949 - DNA, 676 bp, Neisseria meningitidis
atsagacgtaaaatgctaaacgtwsyaraaggcagttatgatggtatgaaaggttttaccattattgaatttttggttgcgggcctgctcagtatgattgtcctgatggcggtcggatcgagttacttcacatcccggaaattaaatgatgcggcaaacgagcgtcttgccgcgcaacaggatttgcggaatgcggcaacattgattgtccgcgatgcgagaatggcaggcggcttcggttgtttcaatatgtccgagcatcctgcaactgatgttattcccgatacgacgcaacaaaattctcctttttccttaaaaaggaacggtatagataaacttattcccatagcggaatcttcaaatatcaattatcagaattttttccaggttggtagcgcattgatttttcaatacggaatcgatgatgttaatgcaagcaccgcgactaccgtcgtcagcagctgtgccgcaatatcgaaaccgggcaagcaaatccctactttagaagatgcaaaaaaagaattgaagattccggatcaggataaggagcaaaatggcaatatagcgcgtcaaaggcatgtggtcaatgcctatgcggtcggcaggattgccgatgaggaaagtttgttccgcttccaattggatgataagggcaagtggggtaatcctcagttgc

SEQ ID NO: 950 - protein, 225 aa, Neisseria meningitidis
  misc_feature (1)..(1): Xaa can be any naturally occurring amino acid
  misc_feature (9)..(10): Xaa can be any naturally occurring amino acid
XRRKMLNVXXGSYDGMKGFTIIEFLVAGLLSMIVLMAVGSSYFTSRKLNDAANERLAAQQDLRNAATLIVRDARMAGGFGCFNMSEHPATDVIPDTTQQNSPFSLKRNGIDKLIPIAESSNINYQNFFQVGSALIFQYGIDDVNASTATTVVSSCAAISKPGKQIPTLEDAKKELKIPDQDKEQNGNIARQRHVVNAYAVGRIADEESLFRFQLDDKGKWGNPQL

SEQ ID NO: 951 - DNA, 999 bp, Neisseria meningitidis
  misc_feature (893)..(893): n is a, c, g, or t
atgagacgtaaaatgctaaacgtaccaaaaggcaattatgatggtatgaagggttttaccattattgaatttttggttgcgggcatgctcagtatgattgtcctgatggcggtcggatcgagttacttcacatcccggaaattaaatgatgcggcaaacgagcgtctttccgcgcaacaggatttgcggaatgcggcaacattgattgtccgcgatgcaagaatggcagggggcttcggttgtttcaatatgtccgagcatactaaaaatgatattattgttgatccaagtaagcaaactcaacatgtccctgtaaaacccggtgccaaacaagaaaatccccttttttctttagagtgggctaatactaataatactaataataatacagctaaattgattcctattgctgaatccacagatattaaatatccgggttttgcccaggctcgtccggcattgattttccaatacggcatcgatgatcttgatgcgagtgctgagactgttgtagtcagcagctgttccaaaatagcaaaaccgggtaagaaaatatctaccttgcaagaagcaaagagtgcattacagattactaatgatgataaacaaaatggaaatatcacccgtcaaaggcatgtggtcaatgcctatgcggtcggcaggattgccggtgaggaaggtttgttccgcttccaattggatgataagggcaagtggggtaatcctcagttgctcgtgaaaaagattagacatatgaaagtgcggtatatctatgtttccgactgtcctgaagatgacgatgccggcaaagaggaaaaattcaaatatacgggtacattcgacagctccacaaatgctgttacgcccgccggggtggaggttttattgagtancggtactgataccaagattgccgcttcttcagacaatcatatttatgcttaccgtatcgatgcgacaatacgcgggggaaatgtatgcgcaaacagaacactttga

SEQ ID NO: 952 - protein, 332 aa, Neisseria meningitidis
  misc_feature (298)..(298): Xaa can be any naturally occurring amino acid
MRRKMLNVPKGNYDGMKGFTIIEFLVAGMLSMIVLMAVGSSYFTSRKLNDAANERLSAQQDLRNAATLIVRDARMAGGFGCFNMSEHTKNDIIVDPSKQTQHVPVKPGAKQENPLFSLEWANTNNTNNNTAKLIPIAESTDIKYPGFAQARPALIFQYGIDDLDASAETVVVSSCSKIAKPGKKISTLQEAKSALQITNDDKQNGNITRQRHVVNAYAVGRIAGEEGLFRFQLDDKGKWGNPQLLVKKIRHMKVRYIYVSDCPEDDDAGKEEKFKYTGTFDSSTNAVTPAGVEVLLSXGTDTKIAASSDNHIYAYRIDATIRGGNVCANRTL

SEQ ID NO: 953 - DNA, 666 bp, Neisseria gonorrhoeae
cccggtgccaaacaagaaaatccccttttttccttaaaaaggagcggcatggataaacaactgattcccgttgctgaatccatagatattaaatatccgggttttatccagcgccttaacgcattggttttccaatacggtatcgatgatcttgatgcgagtgctgagactgttgtagtcagcagctgttccaaaatagcaaaaccgggtaagaaaatatctaccttgcaagaagcaaagagtgcattacagattactaatgatgataaacaaaatggaaatatcacccgtcagaaacatgtggtcaatgcctatgcggtcggcaggtttggcaataatgaggaaagtttgttccgcttccaattggatgataagggcaagtggggtaatcctcagttgctcgtgaaaaaggttaaacgtatggatgtgcggtatatttatgtttccggttgtcctgaagatgaagatgccggcaaagaggaaaaattcagatatacgaataaattcgacaaatccaaaaatgctgttacgcctgccggggtggaggttttattggatagcggccttaatgccaagattgccgcttcttcagacaatagtatttatgcttaccgtatcaatgcgacaatacgcgggggaaatgtatgcgcaaacagaacactttga

SEQ ID NO: 954 - protein, 221 aa, Neisseria gonorrhoeae
PGAKQENPLFSLKRSGMDKQLIPVAESIDIKYPGFIQRLNALVFQYGIDDLDASAETVVVSSCSKIAKPGKKISTLQEAKSALQITNDDKQNGNITRQKHVVNAYAVGRFGNNEESLFRFQLDDKGKWGNPQLLVKKVKRMDVRYIYVSGCPEDEDAGKEEKFRYTNKFDKSKNAVTPAGVEVLLDSGLNAKIAASSDNSIYAYRINATIRGGNVCANRTL

SEQ ID NO: 955 - DNA, 942 bp, Neisseria meningitidis
atgagacgtaaaatgctaaacgtaccaaaaggcagttatgatggtatgaaaggttttaccattattgaatttttggttgcgggcctgctcagtatgattgtcctgatggcggtcggatcgagttacttcacatcccggaaattaaatgatgcggcaaacgagcgtcttgccgcgcaacaggatttgcggaatgcggcaacattgattgtccgcgatgcgagaatggcaggcggcttcggttgtttcaatatgtccgagcatcctgcaactgatgttattcccgatacgacgcaacaaaattctcctttttccttaaaaaggaacggtatagataaacttattcccatagcggaatcttcaaatatcaattatcagaattttttccaggttggtagcgcattgatttttcaatacggaatcgatgatgttaatgcaagcaccgcgactaccgtcgtcagcagctgtgccgcaatatcgaaaccgggcaagcaaatccctactttagaagatgcaaaaaaagaattgaagattccggatcaggataaggagcaaaatggcaatatagcgcgtcaaaggcatgtggtcaatgcctatgcggtcggcaggattgccgatgaggaaggtttgttccgcttccaattggatgataagggcaagtggggtaatcctcagttgctcgtgaaaaaggttagacatatgaaagtgcggtatatctatgtttccggctgtcctgaagatgacgatgccggcaaagaggaaacattcaaatatacggataaattcgacagcgcccaaaatgctgttacgcccgccggggtggaggttttattgagtagcggtactgataccaagattgccgcttcttcagacaatcatatttatgcttaccgtatcgatgcgacaatacgcgggggaaatgtatgcgcaaacagaacactttga

SEQ ID NO: 956 - protein, 313 aa, Neisseria meningitidis
MRRKMLNVPKGSYDGMKGFTIIEFLVAGLLSMIVLMAVGSSYFTSRKLNDAANERLAAQQDLRNAATLIVRDARMAGGFGCFNMSEHPATDVIPDTTQQNSPFSLKRNGIDKLIPIAESSNINYQNFFQVGSALIFQYGIDDVNASTATTVVSSCAAISKPGKQIPTLEDAKKELKIPDQDKEQNGNIARQRHVVNAYAVGRIADEEGLFRFQLDDKGKWGNPQLLVKKVRHMKVRYIYVSGCPEDDDAGKEETFKYTDKFDSAQNAVTPAGVEVLLSSGTDTKIAASSDNHIYAYRIDATIRGGNVCANRTL

SEQ ID NO: 957 - DNA, 618 bp, Neisseria meningitidis
aataatacagctaaattgattcctattgctgaatccacagatattaaatatccgggttttgcccaggctcgtccggcattgattttccaatacggcatcgatgatcttgatgcgagtgctgagactgttgtagtcagcagctgttccaaaatagcaaaaccgggtaagaaaatatctaccttgcaagaagcaaagagtgcattacagattactaatgatgataaacaaaatggaaatatcacccgtcaaaggcatgtggtcaatgcctatgcggtcggcaggattgccggtgaggaaggtttgttccgcttccaattggatgataagggcaagtggggtaatcctcagttgctcgtgaaaaagattagacatatgaaagtgcggtatatctatgtttccgactgtcctgaagatgacgatgccggcaaagaggaaaaattcaaatatacgggtacattcgacagctccacaaatgctgttacgcccgccggggtggaggttttattgagtagcggtactgataccaagattgccgcttcttcagacaatcatatttatgcttaccgtatcgatgcgacaatacgcgggggaaatgtatgcgcaaacagaacactttga

SEQ ID NO: 958 - protein, 205 aa, Neisseria meningitidis
NNTAKLIPIAESTDIKYPGFAQARPALIFQYGIDDLDASAETVVVSSCSKIAKPGKKISTLQEAKSALQITNDDKQNGNITRQRHVVNAYAVGRIAGEEGLFRFQLDDKGKWGNPQLLVKKIRHMKVRYIYVSDCPEDDDAGKEEKFKYTGTFDSSTNAVTPAGVEVLLSSGTDTKIAASSDNHIYAYRIDATIRGGNVCANRTL

SEQ ID NO: 959 - DNA, 612 bp, Neisseria gonorrhoeae
atgcgcaaacagaacactttgacaggaatcccgacttctgacggacagagggggtccgcactgtttatcgtgctgatggtgatgatagtcgtggcctttttggttgtaactgccgcccagtcctacaataccgaacagaggatcagtgccaacgaatcagacaggaaattggctttgtctttagccgaggcggctttgcgggagggcgaatttcaggttttggatttggaatatgctgcggacagtaaggttacgtttagcgaaaactgtgaaaaaggtctgtgtaccgcagtgaatgtgcggacaaataataatggtagtgaagaggcttttggcaatatcgtggtgcaaggcaagcccgccgttgaggcggtgaaacgttcttgccctgcaaagtctggcaaaaattctaccgacctgtgcattgacaataaagggatggaatataataaaggcgcggcaggcgtcagcaaaatgccgcgctatattatcgaatatttaggcgtgaagaacggacaaaatgtttatcgggttactgccaaggcttggggtaagaatgccaataccgtggtcgtccttcaatcttatgtaggcaataatgatgagcaataa

SEQ ID NO: 960 - protein, 203 aa, Neisseria gonorrhoeae
MRKQNTLTGIPTSDGQRGSALFIVLMVMIVVAFLVVTAAQSYNTEQRISANESDRKLALSLAEAALREGEFQVLDLEYAADSKVTFSENCEKGLCTAVNVRTNNNGSEEAFGNIVVQGKPAVEAVKRSCPAKSGKNSTDLCIDNKGMEYNKGAAGVSKMPRYIIEYLGVKNGQNVYRVTAKAWGKNANTVVVLQSYVGNNDEQ

SEQ ID NO: 961 - DNA, 541 bp, Neisseria meningitidis
gggtttgcactgttaatcgtgctgatggtgatratcgtcgtggcttywtggwtgtaactgccgcgcagtcttacaataccgagcagcgkatcagtkccaacgaatcagacaggaaattggctwtgtctttggccgagkcgkctwtgcgggaaggcgaacttcaggttttggatttggaatatgatacggacagtaaggttacatttagcgaaaactgtggaaaaggtctgtstgccgcagtgaatgtgcggacaaataatgataatgaagaggcttttgacaatatcgtggtgcaaggcaagcccaccgttgaggcggtgaagcgttcttgccctgcaaattctaccgacctgtgcattgacaagaaagggwtggaatataagaaaggcacgagaagcgtcacaaaatgccacgttatattatcgaatatttgggcgtgwagaacggagaaaatgtttatcgggttactgccaaggcttggggtaagaatgccaataccgtggtcgtccttcaatcttatgtaagcaataatgatgagtaa

SEQ ID NO: 962 - protein, 180 aa, Neisseria meningitidis
  misc_feature (11)..(11): Xaa can be any naturally occurring amino acid
  misc_feature (17)..(18): Xaa can be any naturally occurring amino acid
  misc_feature (33)..(33): Xaa can be any naturally occurring amino acid
  misc_feature (42)..(42): Xaa can be any naturally occurring amino acid
  misc_feature (47)..(49): Xaa can be any naturally occurring amino acid
  misc_feature (78)..(78): Xaa can be any naturally occurring amino acid
  misc_feature (125)..(125): Xaa can be any naturally occurring amino acid
  misc_feature (148)..(148): Xaa can be any naturally occurring amino acid
GFALLIVLMVXIVVAFXXVTAAQSYNTEQRISXNESDRKLAXSLAEXXXREGELQVLDLEYDTDSKVTFSENCGKGLXAAVNVRTNNDNEEAFDNIVVQGKPTVEAVKRSCPANSTDLCIDKKGXEYKKGTRSVTKMPRYIIEYLGVXNGENVYRVTAKAWGKNANTVVVLQSYVSNNDE

SEQ ID NO: 963 - DNA, 594 bp, Neisseria meningitidis
atgcgcaaacagaacactttgacgggaatcccgacttctgacggacagagggggtttgcactgtttatcgtgctgatggtgatgatcgtcgtggcttttttggttgtaactgccgcgcagtcttacaataccgagcagcggatcagtgccaacgaatcagacaggaaattggctttgtctttggccgaggcggctttgcgggaaggcgaacttcaggttttggatttggaatatgatacggacagtaaggttacatttagcgaaaactgtggaaaaggtctgtgtaccgcagtgaatgtgcggacaaataatgataatgaagaggcttttgacaatatcgtggtgcaaggcaagcccaccgttgaggcggtgaagcgttcttgcactgcaaaatctacaggcctgtgcattgacaataaagggatggaatataagaaaggcacgcaaagcgtcagcaaaatgccacgttatattatcgaatatttgggcgtgaagaacggagaaaatgtttatcgggttactgccaaggcttggggtaagaatgccaataccgtggtcgtccttcaatcttatgtaagcaataatgatgagtaa

SEQ ID NO: 964 - protein, 197 aa, Neisseria meningitidis
MRKQNTLTGIPTSDGQRGFALFIVLMVMIVVAFLVVTAAQSYNTEQRISANESDRKLALSLAEAALREGELQVLDLEYDTDSKVTFSENCGKGLCTAVNVRTNNDNEEAFDNIVVQGKPTVEAVKRSCTAKSTGLCIDNKGMEYKKGTQSVSKMPRYIIEYLGVKNGENVYRVTAKAWGKNANTVVVLQSYVSNNDE

SEQ ID NO: 965 - DNA, 594 bp, Neisseria meningitidis
atgcgcaaacagaacactttgacgggaatcccgacttctgacggacagagggggtttgcactgtttatcgtgctgatggtgatgatcgtcgtggcttttttggttgtaactgccgcgcagtcttacaataccgagcagcggatcagtgccaacgaatcagacaggaaattggctttgtctttggccgaggcggctttgcgggaaggcgaacttcaggttttggatttggaatatgatacggacagtaaggttacatttagcgaaaactgtggaaaaggtctgtgtgccgcagtgaatgtgcggacaaataatgataatgaagaggcttttgacaatatcgtggtgcaaggcaagcccaccgttgaggcggtgaagcgttcttgccctgcaaattctaccgacctgtgcattgacaagaaagggatggaatataagaaaggcacgagaagcgtcagcaaaatgccacgttatattatcgaatatttgggcgtgaagaacggagaaaatgtttatcgggttactgccaaggcttggggtaagaatgccaataccgtggtcgtccttcaatcttatgtaagcaataatgatgagtaa

SEQ ID NO: 966 - protein, 197 aa, Neisseria meningitidis
MRKQNTLTGIPTSDGQRGFALFIVLMVMIVVAFLVVTAAQSYNTEQRISANESDRKLALSLAEAALREGELQVLDLEYDTDSKVTFSENCGKGLCAAVNVRTNNDNEEAFDNIVVQGKPTVEAVKRSCPANSTDLCIDKKGMEYKKGTRSVSKMPRYIIEYLGVKNGENVYRVTAKAWGKNANTVVVLQSYVSNNDE

SEQ ID NO: 967 - DNA, 612 bp, Neisseria gonorrhoeae
atgaagaataatgattgcttgcgcctgaaaaatccccagtccggtatggcgttgatagaagtcttggtcgctatgctcgttctgaccatcggtattttggcattgctgtccgtacagttgcggacagtcgcttccgtcagggaggcggaaacgcaaaccatcgtcagccaaatcacgcaaaacctgatggaaggaatgttgatgaatccgaccattgatttggacagcaacaagaaaaactatagtctttacatgggaaaacagacactatcagctgtggatggtgagtttatgcttgatgccgagaaaagtaaggcgcagttggcagaggaacaattgaagagatttagtcatgagctgaaaaatgccttgccggatgcggtagctattcattacgccgtctgcaaggattcgtcgggtgacgcgccgacattgtccgacagcggtgctttttcttcaaattgcgacaataaggcaaacggggatactttgattaaagtattgtgggtaaatgattcggcaggggattcggatatttcccgtacgaatcttgaagtgagcggcgacaatatcgtatatacctatcaggcaagggtcggaggtcgtgaatga

SEQ ID NO: 968 - protein, 203 aa, Neisseria gonorrhoeae
MKNNDCLRLKNPQSGMALIEVLVAMLVLTIGILALLSVQLRTVASVREAETQTIVSQITQNLMEGMLMNPTIDLDSNKKNYSLYMGKQTLSAVDGEFMLDAEKSKAQLAEEQLKRFSHELKNALPDAVAIHYAVCKDSSGDAPTLSDSGAFSSNCDNKANGDTLIKVLWVNDSAGDSDISRTNLEVSGDNIVYTYQARVGGRE

SEQ ID NO: 969 - DNA, 609 bp, Neisseria meningitidis
  misc_feature (130)..(183): n is a, c, g, or t
atgaagaataatgattgcttccgcctgaaagattcccagtccggtatggcgctgatagaagtcttggttgctatgctcgttctgaccatcggtattttggcactattgtctgtacagttgcggacagtcnnnnnnnnnnnnnnnnnnnnnnnnnnnnnnnnnnnnnnnnnnnnnnnnnnnnnnttgatggagggaatgttgatgaatccgaccattgattcggacagcaacaagaaaaactataatctttacatgggaaaccatacactatcagctgtggatggcgattttgcgattgatgccatgaaaactaaggggcaattggcagaggcacaattgaagagatttagttatgagctgaaaaatgccttgccggatgcggcagccatccattacgccgtctgcaaggattcgtcgggtaacgcgccgacattgtccggcaatgctttttcttcaaattgcgacaataaggcaaacggggatactttaattaaagtattgtgggtaaatgattcggcaggggattcggatatttcccgtacgaatcttgaggtgagcggcgacaatatcgtatatacttatcaggcaagggtcggaggtcgggaatga

SEQ ID NO: 970 - protein, 202 aa, Neisseria meningitidis
  misc_feature (44)..(61): Xaa can be any naturally occurring amino acid
MKNNDCFRLKDSQSGMALIEVLVAMLVLTIGILALLSVQLRTVXXXXXXXXXXXXXXXXXXLMEGMLMNPTIDSDSNKKNYNLYMGNHTLSAVDGDFAIDAMKTKGQLAEAQLKRFSYELKNALPDAAAIHYAVCKDSSGNAPTLSGNAFSSNCDNKANGDTLIKVLWVNDSAGDSDISRTNLEVSGDNIVYTYQARVGGRE

SEQ ID NO: 971 - DNA, 615 bp, Neisseria meningitidis
atgaagaataatgattgcttccgcctgaaaaacccccagtccggtatggcgctgatagaagtcttggtcgctatgctcgttctgaccatcggtattttggcactattgtctgttcagttgcggacagtcgcttccgtcagggaggcagagacgcaaaccatcgtcagtcaaatcacgcaaaacctgatggaaggaatgttgatgaatccgaccattgattcggacagcaacaagaaaaactataatctttacatgggaaaccatcatgcactatcagttgtggatggcgattttcaggttgatgccataaaaactaagacgcagttggcagaggcacaattgaagagatttagttatgagctgaaaaatgccttgccggatgcggcagccatccattacgccgtctgcaaggattcgtcgggtgttgcgccgacattgtccgccggcagtactttttcttcaaattgcgatggtagtgcaaatggggatactttgattaaagtattgtgggtaaatgattcggcaggggattcggatatcgcccgtacgaatcttgagacgaacggcaacaatatcgtatatacctatcaggcaagggtcggaggtcgggaatga

SEQ ID NO: 972 - protein, 204 aa, Neisseria meningitidis
MKNNDCFRLKNPQSGMALIEVLVAMLVLTIGILALLSVQLRTVASVREAETQTIVSQITQNLMEGMLMNPTIDSDSNKKNYNLYMGNHHALSVVDGDFQVDAIKTKTQLAEAQLKRFSYELKNALPDAAAIHYAVCKDSSGVAPTLSAGSTFSSNCDGSANGDTLIKVLWVNDSAGDSDIARTNLETNGNNIVYTYQARVGGRE

SEQ ID NO: 973 - DNA, 609 bp, Neisseria meningitidis
atgaagaataatgattgcttccgcctgaaagattcccagtccggtatggcgctgatagaagtcttggttgctatgctcgttctgaccatcggtattttggcactattgtctgtacagttgcggacagtcgcttccgtcagggaggcggagacacaaaccatcgtcagccaaatcacgcaaaacctgatggagggaatgttgatgaatccgaccattgattcggacagcaacaagaaaaactataatctttacatgggaaaccatacactatcagctgtggatggcgattttgcgattgatgccatgaaaactaaggggcaattggcagaggcacaattgaagagatttagttatgagctgaaaaatgccttgccggatgcggcagccatccattacgccgtctgcaaggattcgtcgggtaacgcgccgacattgtccggcaatgctttttcttcaaattgcgacaataaggcaaacggggatactttaattaaagtattgtgggtaaatgattcggcaggggattcggatatttcccgtacgaatcttgaggtgagcggcgacaatatcgtatatacttatcaggcaagggtcggaggtcgggaatga

SEQ ID NO: 974 - protein, 202 aa, Neisseria meningitidis
MKNNDCFRLKDSQSGMALIEVLVAMLVLTIGILALLSVQLRTVASVREAETQTIVSQITQNLMEGMLMNPTIDSDSNKKNYNLYMGNHTLSAVDGDFAIDAMKTKGQLAEAQLKRFSYELKNALPDAAAIHYAVCKDSSGNAPTLSGNAFSSNCDNKANGDTLIKVLWVNDSAGDSDISRTNLEVSGDNIVYTYQARVGGRE

SEQ ID NO: 975 - DNA, 342 bp, Neisseria gonorrhoeae
atgacgcacacagcctctccacgtgatgaattcatacgcggcataaaagaaagttcgcccatgctgattgggcttttgccttgggcattgatactcggtatgcagggcgggcaaaaaggtatgggccggctggaaatgctgctgatgacggggatgaactttgccggcggctccgaatttgccacggtcaacctgtgggcggaacctctgccgatactgcttatcgccaccataacctttatgattaattcgcggcatatcctgatggggggcggcgcttgccacgcacatgaaagaaataccgctgaaaaaagccgcgcccgcgctgttttttatgtgtga

SEQ ID NO: 976 - protein, 113 aa, Neisseria gonorrhoeae
MTHTASPRDEFIRGIKESSPMLIGLLPWALILGMQGGQKGMGRLEMLLMTGMNFAGGSEFATVNLWAEPLPILLIATITFMINSRHILMGGGACHAHERNTAEKSRARAVFYV

SEQ ID NO: 977 - DNA, 336 bp, Neisseria meningitidis
atgcacaccttccccgcataacgaatttatacgcggcatcaaagaaagttcgcctatgctgattgggctgctgccttgggcattaatactcggtatgcagggcggacaaaaaggcatgagctggctggaaatgttgttgatgaccagtatgaacttcgccggcggctccgagtttgccacggtcaacctgtgggcsgaacctctgccgatactgcttatcgccaccgtaacctttatgattaattctcggcatatcctgatgggggcggcgcttgccccgcacctgaaaggaataccgctgaaaaaagccgtgcccgcactgttttttatgtgtga

SEQ ID NO: 978 - protein, 112 aa, Neisseria meningitidis
MHTPSPHNEFIRGIKESSPMLIGLLPWALILGMQGGQKGMSWLEMLLMTSMNFAGGSEFATVNLWAEPLPILLIATVTFMINSRHILMGGGACPAPERNTAEKSRARTVFYV

SEQ ID NO: 979 - DNA, 341 bp, Neisseria meningitidis
atgacacacataagctcgccccgtaacgaatttatacgcggcatcaaagaaagttcgcccatgctgatcgggcttttgccttgggcattaatactcggtatgcagggtggacaaaaaggcatgagctggctggaaatgttgttgatgaccggtatgaacttcgccggcggctccgagtttgccacggtcaacctgtgggcggaacctctgccgatactgcttatcgccaccgtaacctttatgattaattctcggcatatcctgatgggggcggcacttgccccgcacctgaaagaaataccgctgaaaaaagccgtgcccgcactgttttttatgtgtga

SEQ ID NO: 980 - protein, 113 aa, Neisseria meningitidis
  misc_feature (91)..(91): Xaa can be any naturally occurring amino acid
MTHISSPRNEFIRGIKESSPMLIGLLPWALILGMQGGQKGMSWLEMLLMTGMNFAGGSEFATVNLWAEPLPILLIATVTFMINSRHILMGXGTCPAPERNTAEKSRARTVFYV

SEQ ID NO: 981 - DNA, 735 bp, Neisseria gonorrhoeae
atgcctgacccaatagggattcttttcgctgccgtcggggttgatttttttgccgttgttttgagggggcgttttcaacgaataggcgcggttggcatgttgataataataatcctgatggcggaggtcggaaccaaaacggtcgtaaccgaggttgacgctcaggttgtggcggattttggcggtatcgaaggattttttgaatgccgcctgcaagagcctgtggctttccccgtaaatcacgcggtcggatttgtagtaggaagacggcttgtcggcactcgggcggcaatatttgtccgaaccgtcggcggaacagtgcgtctgctgaaaatgattgtccaaaccgatgccctgccggtcgtaagagaggcgggcataatccgcccaagtgtctttatcggcattggtatagacatattccaaaccgtagcggcttttggtgtgcgtctcgtcgtaaaacacgcccgtaccgtattccgcgcccacctccgcaccgttttcaccgttggtaatcagcccgctgtatttgcggccgcccgcgtatttgccgtagcctcttatcgatccgtattttttattttcatcaaaaaccgccttggtcaggaatgccggaaccgtcatatcgcgcgtgtcgaaagtttgctgcgtgcgttcgagtatgccgccgatgtagtgccgtttgttttcaaaacgaaaacccgggcggaacagccacgaccggctttcgtatga

SEQ ID NO: 982 - protein, 244 aa, Neisseria gonorrhoeae
MPDPIGILFAAVGVDFFAVVLRGRFQRIGAVGMLIIIILMAEVGTKTVVTEVDAQVVADFGGIEGFFECRLQEPVAFPVNHAVGFVVGRRLVGTRAAIFVRTVGGTVRLLKMIVQTDALPVVREAGIIRPSVFIGIGIDIFQTVAAFGVRLVVKHARTVFRAHLRTVFTVGNQPAVFAAARVFAVASYRSVFFIFIKNRLGQECRNRHIARVESLLRAFEYAADVVPFVFKTKTRAEQPRPAFV

SEQ ID NO: 983 - DNA, 915 bp, Neisseria meningitidis
atgcgtgctgcggtagtcgtagcgcaagcccgcgccgacatccgcccacctgcccaaacggacattgtcccgaactgccgcgtaatagcttttaccgttgatgctgcgcggcgtgcagtccgtataagtattgttgcccaagcggcagatttgccccgtaacgacatttcccctgcctatggtgacccaataggggctggtttcactgccgttggggctgatttttttgccgttgttttgagggggcgtgttcgacgaataggcgcggttggcatgttgataataataatcctgatggcggagattagagccaaagcggtcaaacccgagattcacgctcaggttgtggcggattttggcggtatcgaaggattttttgaatgccgcctgcaagagcctgtggctttccccgtaaatcacgcgatcggatttgtaataggaaaacggcttgtcggcactcgggcggcaatatttgtccgaaccgtcggcagaacagtgcgtctgctgaaaatgattatccaaaccgatgccctgccggtcgtaagagaggcgggcataatccgcccaagtgtctttatcggcattggtatagacatattccaaaccgtagcggcttttggtgtgcgtctcgtcgtaaaacacgcccgtaccgtattccgcgcccaccagcgcaccgttttcgccgttggtaaacagtccgccgtatttgtggttgcccgcgtatttgccgttaccgggcaaagaacccgcctgttttttatttgcatcaaaaaccgccttggtcaggaatgccggaaccgtcatatcgcgcgtgtcgaaagtttgttgcgtgtgttcgagtatgccgccgatgtagtgccgcttattctcaaaacgaaaacccgggcggaacagccacgaccggctttcgtatga

SEQ ID NO: 984 - protein, 304 aa, Neisseria meningitidis
MRAAVVVAQARADIRPPAQTDIVPNCRVIAFTVDAARRAVRISIVAQAADLPRNDISPAYGDPIGAGFTAVGADFFAVVLRGRVRRIGAVGMLIIIILMAEIRAKAVKPEIHAQVVADFGGIEGFFECRLQEPVAFPVNHAIGFVIGKRLVGTRAAIFVRTVGRTVRLLKMIIQTDALPVVREAGIIRPSVFIGIGIDIFQTVAAFGVRLVVKHARTVFRAHQRTVFAVGKQSAVFVVARVFAVTGQRTRLFFICIKNRLGQECRNRHIARVESLLRVFEYAADVVPLILKTKTRAEQPRPAFV

SEQ ID NO: 985 - DNA, 900 bp, Neisseria meningitidis
atgcgtgctgcggtagtcgtagcgcaaccccgcgccgacatccgcccacctgcccaaacggacattgtcccgaactgccgcgtaatagcttttgccgttgatgctgcgcggcgtgcagtccgtataagtattgttgcccaagcggcagatttgccccgtaaccacatttcccctgcctatgctgacccaatagggttggtccttgccgccgttggggttggcggttttagggggcgttttcgacgaataggcgcggttggcatgttgataataataatcctgatggcggagattagagtcaaagcggtcaaaaccgagattcacgctcaggttgtggcggattttggcggtatcgaaggattttttgaatgccgcctgcaagagcctgtggctttccccgtaaatcacgcggtcggatttgtagtaggaaaacggcttgtcggcactcgggcggcaatatttgtccgaaccgtcggcagaacagtgcgtctgctgaaaatgattgtccaaaccgatgccctgccggtcgtaagagaggcgggcataatccacccaagtgtctttatcggcattggtatagacatattccaaaccgtagcggcttttggtgtgcgtctcgtcgtaaaacacgcccgtaccgtattccgcgcccaccagcgcaccgttttcgccgttggtaaacagaccgccgtatttgtggtcgcccgcgtatttgccgttgcctcttatcggtccgtattttctattttcatcaaaaaccgccttggtcaggaatgccggaaccgtcatatcgcgcgtgtcgaaagtttgttgcgtgtgttcgagtatgccgccgatgtagtgccgtttgttttcaaaacgaaaacccgggcggaacagccacgatcggctttcgtatga

SEQ ID NO: 986 - protein, 299 aa, Neisseria meningitidis
MRAAVVVAQPRADIRPPAQTDIVPNCRVIAFAVDAARRAVRISIVAQAADLPRNHISPAYADPIGLVLAAVGVGGFRGRFRRIGAVGMLIIIILMAEIRVKAVKTEIHAQVVADFGGIEGFFECRLQEPVAFPVNHAVGFVVGKRLVGTRAAIFVRTVGRTVRLLKMIVQTDALPVVREAGIIHPSVFIGIGIDIFQTVAAFGVRLVVKHARTVFRAHQRTVFAVGKQTAVFVVARVFAVASYRSVFSIFIKNRLGQECRNRHIARVESLLRVFEYAADVVPFVFKTKTRAEQPRSAFV

SEQ ID NO: 987 - DNA, 1194 bp, Neisseria gonorrhoeae
atgatcgacagggaccgtatgttgcgggacacgttggaacgtgtgcgtgcggggtcgttctggttatgggtggtggtggcatcgatgatgtttaccgccggattttcaggcacttatcttctgatggacaatcaggggctgaatttctttttagttttggcgggagtgttgggcatgaatacgctgatgctggcagtatggttggcaacgttgttcctgcgcgtgaaagtgggacggtttttcagcagtccggcgacgtggtttcggggcaaaggccctgtaaatcaggcggtgttgcggctgtatgcggaccagtggcggcaaccttcggtacgatggaaaataggcgcaacggcgcacagcttgtggctctgcacgctgctcggaatgctggtgtcggtattgctgctgcttttggtgcggcaatatacgttcaactgggaaagcacgctgttgagcaatgccgcttcggtacgcgcggtggaaatgttggcatggctgccgtcgaaactcggtttccctgtccccgatgcgcgggcggtcatcgaaggtcgtctgaacggcaatattgccgatgcgcgggcttggtcggggctgctggtcggcagtatcgtctgctacggcatcctgccgcgcctcttggcttgggtagtgtgtaaaatccttttgaaaacaagcgaaaacggattggatttggaaaaaacctattatcaggcggtcatccgccgctggcagaacaaaatcaccgatgcggatacgcgtcgggaaaccgtgtccgccgtttcgccgaaaatcgtcttgaacgatgcgccgaaatgggcgctcatgctggagaccgagtggcaggacggccaatggttcgagggcaggctggcgcaggaatggctggataagggcgttgccgccaatcgggaacaggttgccgcgctggagacagagctgaagcagaaaccggcgcaactgcttatcggcgtacgcgcccaaactgtgccggaccggggcgtgctgcggcagattgtgcggctttcggaagcggcgcagggcggcgcggtggtgcagcttttggcggaacaggggctttcagacgacctttcggaaaagctggaacattggcgtaacgcgctgaccgaatgcggcgcggcgtggcttgagcctgacagggtggcgcaggaaggccgtttgaaagaccaataa

SEQ ID NO: 988 - protein, 397 aa, Neisseria gonorrhoeae
MIDRDRMLRDTLERVRAGSFWLWVVVASMMFTAGFSGTYLLMDNQGLNFFLVLAGVLGMNTLMLAVWLATLFLRVKVGRFFSSPATWFRGKGPVNQAVLRLYADQWRQPSVRWKIGATAHSLWLCTLLGMLVSVLLLLLVRQYTFNWESTLLSNAASVRAVEMLAWLPSKLGFPVPDARAVIEGRLNGNIADARAWSGLLVGSIVCYGILPRLLAWVVCKILLKTSENGLDLEKTYYQAVIRRWQNKITDADTRRETVSAVSPKIVLNDAPKWALMLETEWQDGQWFEGRLAQEWLDKGVAANREQVAALETELKQKPAQLLIGVRAQTVPDRGVLRQIVRLSEAAQGGAVVQLLAEQGLSDDLSEKLEHWRNALTECGAAWLEPDRVAQEGRLKDQ

SEQ ID NO: 989 - DNA, 1194 bp, Neisseria meningitidis
atgattgacaggaaccgtatgctgcgggagacgttggaacgtgtgcgtgcggggtcgttctggttgtgggtggtggcggcgacgtttgcattttttaccggtttttcagtcacttatcttctaatggacaatcagggtctgaatttctttttggttttggcgggcgtgttgggcatgaatacgctgatgctggcagtatggttggcaatgttgttcctgcgtgtgaaagtggggcgttttttcagcagtccggcgacgtggtttcggggcaaagaccctgtaaatcaggcggtgttgcggctgtatgcggacgagtggcggcaaccttcggtacgttggaaaataggcgcaacgtcgcacagcctgtggctctgcacgctgctcggaatgctggtgtcggtattgttgctgcttttggtgcggcaatatacgttcaactgggaaagcacgctgttgagcaatgccgcttcggtacgcgcggtggaaatgttggcatggctgccgtcgaaactcggtttccctgtccccgatgcgcgggcggtcatcgaaggccgtctgaacggcaatattgccgatgcgcgggcttggtcggggctgctggtcggcagtatcgcctgctacggcatcctgccgcgcctgctggcttgggtagtgtgtaaaatccttttgaaaacaagcgaaaacggattggatttggaaaagccctattatcaggcggtcatccgccgctggcagaacaaaatcaccgatgcggatacgcgtcgggaaaccgtgtccgccgtttcaccgaaaatcatcttgaacgatgcgccgaaatgggcggtcatgctggagaccgagtggcaggacggcgaatggttcgagggcaggctggcgcaggaatggctggataagggcgttgccaccaatcgggaacaggttgccgcgctggagacagagctgaagcagaaaccggcgcaactgcttatcggcgtgcgcgcccaaactgtgccggaccgcggcgtgttgcggcagattgtccgactctcggaagcggcgcagggcggcgcggtggtgcagcttttggcggaacaggggctttcagacgacctttcggaaaagctggaacattggcgtaacgcgctggccgaatgcggcgcggcgtggcttgagcctgacagggcggcgcaggaagggcgtttgaaagaccaataa

SEQ ID NO: 990 - protein, 397 aa, Neisseria meningitidis
MIDRNRMLRETLERVRAGSFWLWVVAATFAFFTGFSVTYLLMDNQGLNFFLVLAGVLGMNTLMLAVWLAMLFLRVKVGRFFSSPATWFRGKDPVNQAVLRLYADEWRQPSVRWKIGATSHSLWLCTLLGMLVSVLLLLLVRQYTFNWESTLLSNAASVRAVEMLAWLPSKLGFPVPDARAVIEGRLNGNIADARAWSGLLVGSIACYGILPRLLAWVVCKILLKTSENGLDLEKPYYQAVIRRWQNKITDADTRRETVSAVSPKIILNDAPKWAVMLETEWQDGEWFEGRLAQEWLDKGVATNREQVAALETELKQKPAQLLIGVRAQTVPDRGVLRQIVRLSEAAQGGAVVQLLAEQGLSDDLSEKLEHWRNALAECGAAWLEPDRAAQEGRLKDQ

SEQ ID NO: 991 - DNA, 1203 bp, Neisseria meningitidis
atgatcgacaggaaccgtatgctgcgggagacgttggaacgtgtgcgtgcggggtcgttctggttgtgggtggcggcggcgacgtttgcgttttttaccggtttttcagttacttatcttctaatggacaatcagggtctgaatttctttttggttttggcgggcgtgttgggcatgaatacgctgatgctggcagtatggttggcaatgttgttcctgcgcgtgaaagtggggcgttttttcagcagtccggcgacgtggtttcggggcaaagaccctgtcaatcaggcggtgttgcggctgtatgcggacgagtggcggcaaccttcggtacgttggaaaataggcgcaacgtcgcacagcctgtggctctgcacgctgctcggaatgctggtgtcggtattgttgctgcttttggtgcggcaatatacgttcaactgggaaagcacgctgttgggcgattcgtcttcggtacggctggtggaaatgttggcatggctgcctgcgaaactgggttttcccgtgcctgatgcgcgggcggtcatcgaaggtcgtctgaacggcaatattgccgatgcgcgggcttggtcggggctgctggtcggcagtatcgcctgctacggcatcctgccgcgcctcttggcttgggcggtatgcaaaatccttttgaaaacaagcgaaaacggcttggatttggaaaagccctattatcaggcggtcatccgccgctggcagaacaaaatcaccgatgcggatacgcgtcgggaaaccgtgtccgccgtttcgccgaaaatcgtcttgaacgatgcgccgaaatgggcggtcatgctggagaccgaatggcaggacggcgaatggttcgagggcaggctggcgcaggaatggctggataagggcgttgccgccaatcgggaacaggttgccgcgctggagacagagctgaagcagaaaccggcgcaactgcttatcggcgtgcgcgcccaaactgtgcccgaccgcggcgtgttgcggcagatcgtccgactttcggaagcggcgcagggcggcgcggtggtgcagcttttggcggaacaggggctttcagacgacctttcggaaaagctggaacattggcgtaacgcgctgaccgaatgcggcgcggcgtggctggaacccgacagagcggcgcaggaaggccgtctgaaaaccaacgaccgcacttga

SEQ ID NO: 992 - protein, 400 aa, Neisseria meningitidis
MIDRNRMLRETLERVRAGSFWLWVAAATFAFFTGFSVTYLLMDNQGLNFFLVLAGVLGMNTLMLAVWLAMLFLRVKVGRFFSSPATWFRGKDPVNQAVLRLYADEWRQPSVRWKIGATSHSLWLCTLLGMLVSVLLLLLVRQYTFNWESTLLGDSSSVRLVEMLAWLPAKLGFPVPDARAVIEGRLNGNIADARAWSGLLVGSIACYGILPRLLAWAVCKILLKTSENGLDLEKPYYQAVIRRWQNKITDADTRRETVSAVSPKIVLNDAPKWAVMLETEWQDGEWFEGRLAQEWLDKGVAANREQVAALETELKQKPAQLLIGVRAQTVPDRGVLRQIVRLSEAAQGGAVVQLLAEQGLSDDLSEKLEHWRNALTECGAAWLEPDRAAQEGRLKTNDRT

SEQ ID NO: 993 - DNA, 627 bp, Neisseria gonorrhoeae
atgtatgcaggcgaacgcttcaatacttacagccatttgagcggtttgattctggcggcggcaggtttgatgctgatgctgctgaaaaccataggacacggggacggataccgtatcttcagcgtatcggtttacggcatcagccttcttctgctctatttgagttcctcgctgtaccacggaattgcagccggaaaactgaaaagcattttgaaaaaaaccgaccactgcatgatttatgtgctgattgccggaagctacacaccgtttgcactggtttctttgagaaacgggccgggctggacggtattttcactgtcctggctgctggcggctgcaggaatcgcacaagaactcaccatcggacggaaaagcgaaaaacgtctgctgtctattgcgatttatatcgtaatgggctggatggtcttggcggtaatgaaatccctgacagcctcactcccgccggcaggactggcttggctggcggcaggcggtatgctgtacagcgtcggcatttactggtttgtaaacgatgaaaaaatccgacacgggcacggaatctggcatctgttcgtattgggcggcagcataacccaatttgtcagcgtgtacggttatgtaatctga

SEQ ID NO: 994 - protein, 208 aa, Neisseria gonorrhoeae
MYAGERFNTYSHLSGLILAAAGLMLMLLKTIGHGDGYRIFSVSVYGISLLLLYLSSSLYHGIAAGKLKSILKKTDHCMIYVLIAGSYTPFALVSLRNGPGWTVFSLSWLLAAAGIAQELTIGRKSEKRLLSIAIYIVMGWMVLAVMKSLTASLPPAGLAWLAAGGMLYSVGIYWFVNDEKIRHGHGIWHLFVLGGSITQFVSVYGYVI

SEQ ID NO: 995 - DNA, 504 bp, Neisseria meningitidis
gtatcggtttacggcatcagccttcttctgctctatttgagttcctggctgtaccacggaattgcagccggaaaactgaaaagcattttgaaaaaaaccgaccactgcatgatttatgtgctgattgccggaagctacacaccgtttgcactggtttctttgagaaacgggccgggctggacggtattttcactgtcctggctgctggcggctgcaggaatcgcacaagaactcaccatcggacggaaaagcgaaaaacgtctgctgtctattgtgatttatgtcgtcatgggttggatggtcttggcggtaatgaaatccctgacagcctcactcccgtcggcaggactggcttggctggcggcaggcggtatgctgtacagtgtcggcatttactggtttgtaaacgatgaaaaaatccgacacgggcacggaatctggcatctgttcgtattgggcggcagcatcacccaatttgtcagcgtgtacggttacgtaatctga

SEQ ID NO: 996 - protein, 167 aa, Neisseria meningitidis
VSVYGISLLLLYLSSWLYHGIAAGKLKSILKKTDHCMIYVLIAGSYTPFALVSLRNGPGWTVFSLSWLLAAAGIAQELTIGRKSEKRLLSIVIYVVMGWMVLAVMKSLTASLPSAGLAWLAAGGMLYSVGIYWFVNDEKIRHGHGIWHLFVLGGSITQFVSVYGYVI

SEQ ID NO: 997 - DNA, 627 bp, Neisseria meningitidis
atgtatacaggcgaacgcttcaatacttacagccatttgagcggtttgattctggcggcggcaggtttggcgctgatgctgctgaaaaccataggacacggggacggctaccgtatcttcagcgtatcggtttacggcatcagccttcttctgctctatttgagttcctcgctgtaccacggaattgcagccggaaaactgaaaagcattttgaaaaaaaccgaccactgcatgatttatgtgctgattgccggaagctacacaccgtttgcactggtttctttgagaaacgggccgggctggacggtattttcactgtcctggctgctggcggctgcaggaatcgcacaagaactcaccattggacggaaaagcgaaaaacgactgctgtctattgcgatttatatcgtaatgggctggatggtcttggcggtaatgaaatccctgacagcctcactcccgccggcaggactggcttggctggcggcaggcggtatgctgtacagcgtcggcatttactggtttgtaaacgatgaaaaaatccgacacgggcacggaatctggcatctgttcgtattgggcggcagcatcacccaatttgtcagcgtgtacggttacgtaatctga

SEQ ID NO: 998 - protein, 208 aa, Neisseria meningitidis
MYTGERFNTYSHLSGLILAAAGLALMLLKTIGHGDGYRIFSVSVYGISLLLLYLSSSLYHGIAAGKLKSILKKTDHCMIYVLIAGSYTPFALVSLRNGPGWTVFSLSWLLAAAGIAQELTIGRKSEKRLLSIAIYIVMGWMVLAVMKSLTASLPPAGLAWLAAGGMLYSVGIYWFVNDEKIRHGHGIWHLFVLGGSITQFVSVYGYVI

SEQ ID NO: 999 - DNA, 567 bp, Neisseria gonorrhoeae
atggttggacaggaagccttgcggggtcagttcgtcgccgtgttcgctgccgcgttgcgttacgctgtcaaaacctgcgccgatttccacgcctttgacggcgttgatgcccatcatcgcgtaggcgatttcggcatcgaggcggtcgaaaacgggttcgcccaaaccgacggggacgttggcggcttcgatatgcagtttcgcgccgacggaatccaaggatttgcgcacaccgtccatatagtgttccagttcggcgatttggctttggttggcggcaaaaaaaggattttgggaaatgtgttcgctgccttcaaaccggatttttttttcgccgacttgggtaacgtaggcggtgatttccgtgccgaatttttctttcagccattttttggcaacggctccggcggcaacgcgggctgcggtttcgcgggcggaactcctgccgccgccccggtagtcgcgcgtaccgtatttgtgccaataggtatagtcggcgtgtccggggcggaaggcggtggcgatgtcgccgtagtcttcgctgcgctggtcggtgttgcggattag

SEQ ID NO: 1000 - protein, 188 aa, Neisseria gonorrhoeae
MVGQEALRGQFVAVFAAALRYAVKTCADFHAFDGVDAHHRVGDFGIEAVENGFAQTDGDVGGFDMQFRADGIQGFAHTVHIVFQFGDLALVGGKKRILGNVFAAFKPDFFFADLGNVGGDFRAEFFFQPFFGNGSGGNAGCGFAGGTPAAAPVVARTVFVPIGIVGVSGAEGGGDVAVVFAALVGVAD

SEQ ID NO: 1001 - DNA, 567 bp, Neisseria meningitidis
gtggttggacaggaagccttgcggggtcagttcgtcgccgtgttcgctgccgcgttgcgttacgctgtcaaaacctgcgccgatttccacgcctttgacggcgttgatgcccatcatcgcgtaggcgatttcggcatcgaggcggtcaaaaacaggttcgcccaagccgacagggacattggctgcttcgatatgcagcttcgcgccgacggaatccaaggatttgcgcacgctgtccatatagttttccagctcggcaatttggctatggttggcggcaaaaaaaggattttgggaaatgtgttcgcagccttcaaaccggatttctttttcgccgacttgggtaacgtaggcggtgatttccgtgccgaatttttctttcaaccattttttggcaacggctccggcagcaacgcgggcggcggtttcacgggcggagctcctgccgccgccgcggtagtcgcgcgtgccgtatttgtgccaataggtatagtcggcgtggccggggcggaagctggtggcgatgttgccgtagtctttgctgcgctggtcggtattgcggattaa

SEQ ID NO: 1002 - protein, 188 aa, Neisseria meningitidis
VVGQEALRGQFVAVFAAALRYAVKTCADFHAFDGVDAHHRVGDFGIEAVKNRFAQADRDIGCFDMQLRADGIQGFAHAVHIVFQLGNLAMVGGKKRILGNVFAAFKPDFFFADLGNVGGDFRAEFFFQPFFGNGSGSNAGGGFTGGAPAAAAVVARAVFVPIGIVGVAGAEAGGDVAVVFAALVGIAD

SEQ ID NO: 1003 - DNA, 567 bp, Neisseria meningitidis
gtggttggacaggaagccttgcggggtgagttcgtcgccgtgttcgctgccgcgttgcgttacgctgtcaaaacctgcgccgatttccacgcctttgacggcgttgatgcccatcatggcgtaggcgatttcggcatcgaggcggtcgaatacgggttcgcccaagccgacggggacgttggcggcttcaatatgcagcttcgcgccgacggaatccaaggatttgcgcacgctgtccatatagttttccagctcggcaatttggctatggttggcggcaaaaaaaggattttgggaaatgtgttcgcagccttcaaaccggatttctttttcgccgacttgggtaacgtaggcggtgatttccgtgccgaatttttctttcaaccattttttggcaacggctccggcggcaacgcgggcggcggtttcgcgggcggaactcctgccgccgccccggtagtcgcgcgtgccgtatttgtgccaataggtatagtcggcgtggccggggcggaagctggtggcgatgttgccgtagtctttgctgcgctggtcggtattgcggattaa

SEQ ID NO: 1004 - protein, 188 aa, Neisseria meningitidis
VVGQEALRGEFVAVFAAALRYAVKTCADFHAFDGVDAHHGVGDFGIEAVEYGFAQADGDVGGFNMQLRADGIQGFAHAVHIVFQLGNLAMVGGKKRILGNVFAAFKPDFFFADLGNVGGDFRAEFFFQPFFGNGSGGNAGGGFAGGTPAAAPVVARAVFVPIGIVGVAGAEAGGDVAVVFAALVGIAD

SEQ ID NO: 1005 - DNA, 720 bp, Neisseria gonorrhoeae
atgctcgcggtacgcaatcggggttggcacggcgcagtcgtccatttccgcagctgcggcggcgtagcgaacaccgccccggtgttctaccacttgggtgataccgccgaaatcgcctttgctttggacacgctcaccgcgcgttaccgtgaaatatacgccgtcggcgtatcgctgggcggcaacgcgccggcaaaatatttgggcgaacagggcaaaaaggcattgccgcacgcctcggccgccgtatccgcccccgttgatgcagaggcggcaggcagccgcttcgacagcggcatcacgcggctgctctacacgcgctacttcctccgcacactgatacccaaagcacgttcgctccaaggttttcagacggcatttgccgcagggtgcaaaacactgggcgagtttgacgaccgtttcaccgcaccgctgcacggctttgccgaccggcacgactactaccgccaaacttcctgcaaaccgctgctcaaacacgttgccaaaccgctgctcctgctcaatgccgccaacgaccccttcctgccgcccgaagccctgccccgtgcagacgaagcgtccgaagccgttaccctgttccaacctgcacacggcgggcacgccggctttgtcagcagcaccggcggcaggctgcacctgcaatggctgccgcagaccgtcctgtcctattttgacagcttccgcacaaacaggcgttaa

SEQ ID NO: 1006 - protein, 239 aa, Neisseria gonorrhoeae
MLAVRNRGWHGAVVHFRSCGGVANTAPVFYHLGDTAEIAFALDTLTARYREIYAVGVSLGGNAPAKYLGEQGKKALPHASAAVSAPVDAEAAGSRFDSGITRLLYTRYFLRTLIPKARSLQGFQTAFAAGCKTLGEFDDRFTAPLHGFADRHDYYRQTSCKPLLKHVAKPLLLLNAANDPFLPPEALPRADEASEAVTLFQPAHGGHAGFVSSTGGRLHLQWLPQTVLSYFDSFRTNRR

SEQ ID NO: 1007 - DNA, 719 bp, Neisseria meningitidis
atgcttgcggtacgcgatcggggttggcacggcgtagtcgtccatttccgcagctgcggcggcattgccaacaccgctccggtgttctaccacttggcgataccgccgaaatcgcctttactttggacacgttcgccgcgcgttaccgtgaaatatacgccgtcggcgtatcgctgggcggcaacgcgctggcaaaatatttgggcgaacagggcaaaaaggcattgccgcaagccgctgccgtcatctccgcccccgtcgatgcagaggcggcaggcagacgcttcgacagcggcatcacgcggctgctctacacgcgctacttcctccgcaccctgatacccaaagcaaaatcgctccaaggttttcagacggcatttgccgcagggtgcaaaacactgggcgagtttgacgaccgcttcaccgcaccgctgcacggctttgccgaccggcacgactactaccgccaaacttcctgcaaaccgctgctcaaacacgttgccaaaccgctgctcctgctcaatgccgtcaacgaccccttcctgccgcccgaagccctgccccgcgcagacgaagtatccgaagccgttaccctgttccagccggcatatggtggtcatgtcggctttgtcagcagcaccggcggcaggctgcacctgcaatggctgccgcagaccgtcctgtcctatttcgacagcttccgcacaaacaggcgttaa

SEQ ID NO: 1008 - protein, 239 aa, Neisseria meningitidis
  misc_feature (31)..(31): Xaa can be any naturally occurring amino acid
MLAVRDRGWHGVVVHFRSCGGIANTAPVFYXLGDTAEIAFTLDTFAARYREIYAVGVSLGGNALAKYLGEQGKKALPQAAAVISAPVDAEAAGRRFDSGITRLLYTRYFLRTLIPKAKSLQGFQTAFAAGCKTLGEFDDRFTAPLHGFADRHDYYRQTSCKPLLKHVAKPLLLLNAVNDPFLPPEALPRADEVSEAVTLFQPAYGGHVGFVSSTGGRLHLQWLPQTVLSYFDSFRTNRR

SEQ ID NO: 1009 - DNA, 720 bp, Neisseria meningitidis
atgctcgcggtacgcgatcggggttggaacggcgtagtcgtccatttccgcagctgcggcggcgtagcgaacaccgccccggtgttctaccacttgggcgataccgccgaaattgcctttactttggacacgctcgccgcgcgttaccgtgaaatatacgccgtcggcgtatcgctgggcggcaacgcgctggcaaaatatttgggcgaacagggcgaaaacgcgctgccgcaagccgccgccgtcatctccgcacccgtcgatgcagaggcggcaggcaaccgcttcgacagcggcatcacacggctgctctacacgcgctacttcctccgcacactgatacccaaagcacggtcgctccaaggttttcagacggcatttgccgcagggtgcaaaacactgggcgagtttgacgaccgtttcaccgcaccgctgcacggctttgccgatcggcacgactactaccgccaaacttcctgcaaaccgctgctcaaacacgttgccaaaccgctgctcctgctcaatgccgtcaacgaccccttcctgccgcccgaagcgctgccccgcgcagacgaagtgtccgaagccgttaccctgttccagccgacacacggtggtcatgtcggctttgtcggcagcaccggcggcaggctgcacctgcaatggttgccgcagaccgtcctgtcctatttcgacagcttccgcacaaacaggcgttaa

SEQ ID NO: 1010 - protein, 239 aa, Neisseria meningitidis
MLAVRDRGWNGVVVHFRSCGGVANTAPVFYHLGDTAEIAFTLDTLAARYREIYAVGVSLGGNALAKYLGEQGENALPQAAAVISAPVDAEAAGNRFDSGITRLLYTRYFLRTLIPKARSLQGFQTAFAAGCKTLGEFDDRFTAPLHGFADRHDYYRQTSCKPLLKHVAKPLLLLNAVNDPFLPPEALPRADEVSEAVTLFQPTHGGHVGFVGSTGGRLHLQWLPQTVLSYFDSFRTNRR

SEQ ID NO: 1011 - DNA, 960 bp, Neisseria gonorrhoeae
atgattttgacaccgccggacacgccctttttcctccgcaacggcaatgccgacacgattgccgccaaattcctgcaacaccccgcacccgcataccgccgcgagatgcttcccgacagcacgggtaaaaccaaaaccgcctacgacttttcagcaggcggcatttcgcccgatgcgccgctggtcgtgctgtttcacggtttggaaggaagcagccgcagccattacgcggtcgaactgatgctcgcggtacgcaatcggggttggcacggcgcagtcgtccatttccgcagctgcggcggcgtagcgaacaccgccccggtgttctaccacttgggtgataccgccgaaatcgcctttgctttggacacgctcaccgcgcgttaccgtgaaatatacgccgtcggcgtatcgctgggcggcaacgcgccggcaaaatatttgggcgaacagggcaaaaaggcattgccgcacgcctcggccgccgtatccgcccccgttgatgcagaggcggcaggcagccgcttcgacagcggcatcacgcggctgctctacacgcgctacttcctccgcacactgatacccaaagcacgttcgctccaaggttttcagacggcatttgccgcagggtgcaaaacactgggcgagtttgacgaccgtttcaccgcaccgctgcacggctttgccgaccggcacgactactaccgccaaacttcctgcaaaccgctgctcaaacacgttgccaaaccgctgctcctgctcaatgccgccaacgaccccttcctgccgcccgaagccctgccccgtgcagacgaagcgtccgaagccgttaccctgttccaacctgcacacggcgggcacgccggctttgtcagcagcaccggcggcaggctgcacctgcaatggctgccgcagaccgtcctgtcctattttgacagcttccgcacaaacaggcgttaa

SEQ ID NO: 1012 - protein, 319 aa, Neisseria gonorrhoeae
MILTPPDTPFFLRNGNADTIAAKFLQHPAPAYRREMLPDSTGKTKTAYDFSAGGISPDAPLVVLFHGLEGSSRSHYAVELMLAVRNRGWHGAVVHFRSCGGVANTAPVFYHLGDTAEIAFALDTLTARYREIYAVGVSLGGNAPAKYLGEQGKKALPHASAAVSAPVDAEAAGSRFDSGITRLLYTRYFLRTLIPKARSLQGFQTAFAAGCKTLGEFDDRFTAPLHGFADRHDYYRQTSCKPLLKHVAKPLLLLNAANDPFLPPEALPRADEASEAVTLFQPAHGGHAGFVSSTGGRLHLQWLPQTVLSYFDSFRTNRR

SEQ ID NO: 1013 - DNA, 957 bp, Neisseria meningitidis
atgattttaacaccgccggacacgccctttttcctccgcaacggcaatgccgacacgattgccgccaaattcctgcaacgccccgcgcccgcataccgccgagagctgcttcccgacagcacgggtaaaaccaaagtcgcctacgacttttcagacggcatttcgcccgatgcgccgctggtcgtgctgtttcacggtttggaaggaagcagccgcagccattacgcggtcgaactgatgcttgcggtacgcgatcggggttggcacggcgtagtcgtccatttccgcagctgcggcggcattgccaacaccgctccggtgttctaccacttgggcgataccgccgaaatcgcctttactttggacacgttcgccgcgcgttaccgtgaaatatacgccgtcggcgtatcgctgggcggcaacgcgctggcaaaatatttgggcgaacagggcaaaaaggcattgccgcaagccgctgccgtcatctccgcccccgtcgatgcagaggcggcaggcagacgcttcgacagcggcatcacgcggctgctctacacgcgctacttcctccgcaccctgatacccaaagcaaaatcgctccaaggttttcagacggcatttgccgcagggtgcaaaacactgggcgagtttgacgaccgcttcaccgcaccgctgcacggctttgccgaccggcacgactactaccgccaaacttcctgcaaaccgctgctcaaacacgttgccaaaccgctgctcctgctcaatgccgtcaacgaccccttcctgccgcccgaagccctgccccgcgcagacgaagtatccgaagccgttaccctgttccagccggcatatggtggtcatgtcggctttgtcagcagcaccggcggcaggctgcacctgcaatggctgccgcagaccgtcctgtcctatttcgacagcttccgcacaaacaggcgttaa

SEQ ID NO: 1014 - protein, 318 aa, Neisseria meningitidis
MILTPPDTPFFLRNGNADTIAAKFLQRPAPAYRRELLPDSTGKTKVAYDFSDGISPDAPLVVLFHGLEGSSRSHYAVELMLAVRDRGWHGVVVHFRSCGGIANTAPVFYHLGDTAEIAFTLDTFAARYREIYAVGVSLGGNALAKYLGEQGKKALPQAAAVISAPVDAEAAGRRFDSGITRLLYTRYFLRTLIPKAKSLQGFQTAFAAGCKTLGEFDDRFTAPLHGFADRHDYYRQTSCKPLLKHVAKPLLLLNAVNDPFLPPEALPRADEVSEAVTLFQPAYGGHVGFVSSTGGRLHLQWLPQTVLSYFDSFRTNRR

SEQ ID NO: 1015 - DNA, 957 bp, Neisseria meningitidis
atgattttgacaccgccggacacaccctttttcctccgcaacggcaatgccgacacgattgccgccaaattcctgcaacgctccgcacctgcataccgccgcgagctgcttcccgacagcacgggtaaaaccaaaaccgcctacgacttttcagacggcatttcgcccgatgcgccgctggtcgtgctgtttcacggtttggagggcggcagtggcagccattacgcggtcgaactgatgctcgcggtacgcgatcggggttggaacggcgtagtcgtccatttccgcagctgcggcggcgtagcgaacaccgccccggtgttctaccacttgggcgataccgccgaaattgcctttactttggacacgctcgccgcgcgttaccgtgaaatatacgccgtcggcgtatcgctgggcggcaacgcgctggcaaaatatttgggcgaacagggcgaaaacgcgctgccgcaagccgccgccgtcatctccgcacccgtcgatgcagaggcggcaggcaaccgcttcgacagcggcatcacacggctgctctacacgcgctacttcctccgcacactgatacccaaagcacggtcgctccaaggttttcagacggcatttgccgcagggtgcaaaacactgggcgagtttgacgaccgtttcaccgcaccgctgcacggctttgccgatcggcacgactactaccgccaaacttcctgcaaaccgctgctcaaacacgttgccaaaccgctgctcctgctcaatgccgtcaacgaccccttcctgccgcccgaagcgctgccccgcgcagacgaagtgtccgaagccgttaccctgttccagccgacacacggtggtcatgtcggctttgtcggcagcaccggcggcaggctgcacctgcaatggttgccgcagaccgtcctgtcctatttcgacagcttccgcacaaacaggcgttaa

SEQ ID NO: 1016 - protein, 318 aa, Neisseria meningitidis
MILTPPDTPFFLRNGNADTIAAKFLQRSAPAYRRELLPDSTGKTKTAYDFSDGISPDAPLVVLFHGLEGGSGSHYAVELMLAVRDRGWNGVVVHFRSCGGVANTAPVFYHLGDTAEIAFTLDTLAARYREIYAVGVSLGGNALAKYLGEQGENALPQAAAVISAPVDAEAAGNRFDSGITRLLYTRYFLRTLIPKARSLQGFQTAFAAGCKTLGEFDDRFTAPLHGFADRHDYYRQTSCKPLLKHVAKPLLLLNAVNDPFLPPEALPRADEVSEAVTLFQPTHGGHVGFVGSTGGRLHLQWLPQTVLSYFDSFRTNRR

SEQ ID NO: 1017 - DNA, 381 bp, Neisseria gonorrhoeae
atgggcaggcatttcgggcgcagacgttttctgacggctgccgccgttgctgtggccggtgcggcggtttcttttttgccgaatccttttgccgccggcggcgaaaaacgcaacatggataaaaaacgcgatgaaaatgtgtttttctggaaaggtgtcgcgctgggttccggcgcggagctgcgcctgttcggcgtggacgacagacaggcggcggatttggtcaataaggttttggcggaagtggcgcgtttggaaaaaatgttcagcctttaccgtgaagacagcctgatcagccgtctgaaccgcgacggttatctgacttcgcctccggcggattttttggaactgttgagcctggccgcgatattcacgcgctga

SEQ ID NO: 1018 - protein, 126 aa, Neisseria gonorrhoeae
MGRHFGRRRFLTAAAVAVAGAAVSFLPNPFAAGGEKRNMDKKRDENVFFWKGVALGSGAELRLFGVDDRQAADLVNKVLAEVARLEKMFSLYREDSLISRLNRDGYLTSPPADFLELLSLAAIFTR

SEQ ID NO: 1019 - DNA, 378 bp, Neisseria meningitidis
atgggcaggcatttcgggcgcagcgttttctgacggttgccgccgttgcggcggggacgcggcggtttctttcctgccgaatccttttgccgccgatgatgaaaaacgcaacggggatgaaaaacgcaatgaaaatgtgtttttctggaaaggtgtcgcactgggttccggtgcggactccgtctgttcggtgtggacgacaggcgtgcggcggatttggtcaacaaggttttggcggaagtggcgcgtttggaaaaattgttcagcctttaccgtgaagacagcctgatcagccgcctgaacagggacggttatctgacttcgccgtcggcggattttttggaactgktgagcctggccgcgatattcacgckctga

SEQ ID NO: 1020 - protein, 126 aa, Neisseria meningitidis
  misc_feature (7)..(7): Xaa can be any naturally occurring amino acid
  misc_feature (20)..(20): Xaa can be any naturally occurring amino acid
  misc_feature (60)..(60): Xaa can be any naturally occurring amino acid
  misc_feature (118)..(118): Xaa can be any naturally occurring amino acid
  misc_feature (126)..(126): Xaa can be any naturally occurring amino acid
MGRHFGXQRFLTVAAVAAGXAAVSFLPNPFAADDEKRNGDEKRNENVFFWKGVALGSGAXLRLFGVDDRRAADLVNKVLAEVARLEKLFSLYREDSLISRLNRDGYLTSPSADFLELXSLAAIFTX

SEQ ID NO: 1021 - DNA, 381 bp, Neisseria meningitidis
atgggcaggcatttcgggcgcaggcgttttttgacagttgccgccgttgcggcggcgggcgcggcggtttctttcctgccgaatccttttgccgccgatgatgaaaaacgcaataaagatgaaaaacgcaatgaaaatgtgtttttctggaaaggtgtcgcactgggttccggtgcggagctccgtctgttcggtgtggacgacaggcgtgcggcggatttggtcaacaaggttttggcggaagtggcgcgtttggaaaaaatgttcagcctttaccgtgaagacagcctgatcagccgtctgaaccgtgacggttatttgacttcgccgccggcggattttttggaactgttgagcctggccgtgatattcacgcgctga

SEQ ID NO: 1022 - protein, 126 aa, Neisseria meningitidis
MGRHFGRRRFLTVAAVAAAGAAVSFLPNPFAADDEKRNKDEKRNENVFFWKGVALGSGAELRLFGVDDRRAADLVNKVLAEVARLEKMFSLYREDSLISRLNRDGYLTSPPADFLELLSLAVIFTR

SEQ ID NO: 1023 - DNA, 1203 bp, Neisseria gonorrhoeae
  misc_feature (1134)..(1134): n is a, c, g, or t
atgcgccgcttcctaccgatcgcagccatatgcgccgtcgtcctgctgtacggattgacggcggcgaccggcagcaccagttcgctggcggattatttctggtggatagtctcgttcagcgcaatgctgctgctggtgttgtccgccgttttggcacgttatgtcatattgctgttgaaagacaggcgcaacggcgtgttcggttcgcagattgccaaacgcctttccgggatgttcacgctggtcgccgtactgcccggcttgttcctgttcggcatttccgcgcagtttatcaacggcacgattaattcgtggttcggcaacgacacccacgaagccctcgaacgcagccttaatttgagcaagtccgcactggatttggcggcagacaatgccgtcagcaacgccgttcccgtacagatagacctcatcggcaccgcctccctgtcgggcaatatgggcagtgtgctggaacactacgccggcagcggttttgcccagcttgccctgtacaatgccgcaagcgggaaaatcgaaaaaagcatcaatccgcaccaattcgaccagccgcttcccgacaaagaacattgggaacagattcagcagaccggttcggttcggagtttggaaagcataggcggcgtattgtacgcgcagggatggttgtcggcaggtacgcacaacgggcgcgattacgcgctgttcttccgccagccgattcccgaaaatgtggcacaggatgccgttctgattgaaaaggcgcgggcgaaatatgccgaattgagttacagcaaaaaaggtttgcagaccttttttctggtaaccctgctgattgcctcgctgctgtcgatttttcttgcgctggtaatggcactgtattttgcccgccgtttcgtcgaacccattctgtcgcttgccgagggcgcaaaggcggtggcgcagggtgatttcagccagacgcgccccgtattgcgcaacgacgagttcggacgtttgaccaagctgttcaaccatatgaccgagcagctttccatcgccaaagaagcagacgaacgcaaccgccggcgcgaggaagccgcccgtcactacctcgagtgcgtgttggatgggttgactaccggtgtggtggtctcntaccccctctcttgttgccgtaccgcggtgttttccacttgtcattcctcccctctttcttatttctaa

SEQ ID NO: 1024 - protein, 400 aa, Neisseria gonorrhoeae
MRRFLPIAAICAVVLLYGLTAATGSTSSLADYFWWIVSFSAMLLLVLSAVLARYVILLLKDRRNGVFGSQIAKRLSGMFTLVAVLPGLFLFGISAQFINGTINSWFGNDTHEALERSLNLSKSALDLAADNAVSNAVPVQIDLIGTASLSGNMGSVLEHYAGSGFAQLALYNAASGKIEKSINPHQFDQPLPDKEHWEQIQQTGSVRSLESIGGVLYAQGWLSAGTHNGRDYALFFRQPIPENVAQDAVLIEKARAKYAELSYSKKGLQTFFLVTLLIASLLSIFLALVMALYFARRFVEPILSLAEGAKAVAQGDFSQTRPVLRNDEFGRLTKLFNHMTEQLSIAKEADERNRRREEAARHYLECVLDGLTTGVVVSYPLSCCRTAVFSTCHSSPLSYF

SEQ ID NO: 1025 - DNA, 1767 bp, Neisseria meningitidis
atgcgccgttttctaccgatcgcagccatatgcgccgtcgtcctgttgtacggactgacggcggcaaccggcagcaccagttcgctggcggattatttctggtggattgttgcgttcagcgcaatgctgctgctggtgttgtccgccgttttggcacgttatgtcatattgctgttgaaagacaggcgcgacggcgtattcggttcgcagattgccaaacgcctttctgggatgtttacgctggttgccgtactgcccggcgtgtttctgttcggcgtttccgcacagttcatcaacggcacgattaattcgtggttcggcaacgatacccacgaggcgcttgaacgcagcctcaatttgagcaagtccgcattgaatttggcggcagacaacgccctcggcaacgccgtccccgtgcagatagacctcatcggcgcggcttccctgcccggggatatgggcagggtgctggaacattacgccggcagcggttttgcccagcttgccctgtacaatgccgcaagcggcaaaatcgaaaaaagcatcaacccgcacaagctcgatcagccgtttccaggtaaggcgcgttgggaaaaaatccaacgggcgggttcggtcagggatttggaaagcataggcggcgtattgtacgcgcagggctggctgtcggcgggtacgcacaacgggcgcgattacgccttgtttttccgtcagccggttcccaaaggcgtggcagaggatgccgtcttaatcgaaaaggcaagggcgaaatatgctgagttgagttacagcaaaaaaggtttgcagacctttttcctggcaaccctgctgattgcctcgctgctgtcgatttttcttgcactggtcatggcactgtatttcgcccgccgtttcgtcgaacccgtcctatcgcttgccgagggggcgaaggcggtggcgcaaggcgatttcagccagacgcgccccgtgttgcgcaacgacgagttcggacgcttgaccaagttgttcaaccacatgaccgagcagctttccatcgccaaagaagcagacgagcgcaaccgccggcgcgaggaagccgccaggcattatcttgaatgcgtgttggaggggctgaccacgggcgtggtggtgtttgacgaacaaggctgtctgaaaacsttcaacaaagcggcggaacagattytggggatgccgcttacccccctgtggggcagcagccggcacggttggcacggcgtttcggcgcagcagtccctgcttgccgaagtgtttgccgccatcggcgcggcggcaggtacggacaaaccggtccatgtgaaatatgccgcgccggacgatgccaaaatcctgctgggcaaggcaaccgtcctgcccgaagacaacggcaacggcgtggtaatggtgattgacgacatcaccgttttgatacacgcgcaaaaagaagccgcgtggggcgaagtggcgaagcggctggcacacgaaatccgcaatccgctcacgcccatccagctttccgccgaacggstggcgtkgaaattgggcgggaagctggatgagcaggatgcgcaaatcctgacgcgttcgaccgacaccatcgtcaaacaggtggcggcattgaaggaaatggtcgaagcattccgcaattatgcgcgttccccttcgctcaaattggaaaatcaggatttgaacgccttaatcggcgatgtgttggcattgtatgaagccggtccgtgccggtttgcggcggacttgccggcgaaccgctga

SEQ ID NO: 1026 - protein, 588 aa, Neisseria meningitidis
  misc_feature (509)..(509): Xaa can be any naturally occurring amino acid
  misc_feature (511)..(511): Xaa can be any naturally occurring amino acid
MRRFLPIAAICAVVLLYGLTAATGSTSSLADYFWWIVAFSAMLLLVLSAVLARYVILLLKDRRDGVFGSQIAKRLSGMFTLVAVLPGVFLFGVSAQFINGTINSWFGNDTHEALERSLNLSKSALNLAADNALGNAVPVQIDLIGAASLPGDMGRVLEHYAGSGFAQLALYNAASGKIEKSINPHKLDQPFPGKARWEKIQRAGSVRDLESIGGVLYAQGWLSAGTHNGRDYALFFRQPVPKGVAEDAVLIEKARAKYAELSYSKKGLQTFFLATLLIASLLSIFLALVMALYFARRFVEPVLSLAEGAKAVAQGDFSQTRPVLRNDEFGRLTKLFNHMTEQLSIAKEADERNRRREEAARHYLECVLEGLTTGVVVFDEQGCLKTFNKAAEQILGMPLTPLWGSSRHGWHGVSAQQSLLAEVFAAIGAAAGTDKPVHVKYAAPDDAKILLGKATVLPEDNGNGVVMVIDDITVLIHAQKEAAWGEVAKRLAHEIRNPLTPIQLSAERXAXKLGGKLDEQDAQILTRSTDTIVKQVAALKEMVEAFRNYARSPSLKLENQDLNALIGDVLALYEAGPCRFAADLPANR

SEQ ID NO: 1027 - DNA, 2121 bp, Neisseria meningitidis
atgcgccgttttctaccgatcgcagccatatgcgccgtcgtcctgttgtacggactgacggcggcaaccggcagcaccagttcgctggcggattatttctggtggattgttgcgttcagcgcaatgctgctgctggtgttgtccgccgttttggcacgttatgtcatattgctgttgaaagacaggcgcgacggcgtattcggttcgcagattgccaaacgcctttccgggatgtttacgctggttgccgtactgcccggcgtgtttctgttcggcgtttccgcacagtttatcaacggcacgattaattcgtggttcggcaacgatacccacgaggcgcttgaacgcagcctcaatttgagcaagtccgcattgaatctggcggcagacaacgcccttggcaacgccatccccgtgcagatagacctcatcggcgcggcttccctgcccggggatatgggcagggtgctggaacattacgccggcagcggttttgcccagcttgccctgtacaatgccgcaagcggcaaaatcgaaaaaagcatcaacccgcacaagctcgatcagccgtttccaggtaaggcgcgttgggaaaaaatccaacaggcgggttcggtcagggatttggaaagcataggcggcgtattgtacgcgcagggctggctgtcggcaggtacgcacaacgggcgcgattacgccttgtttttccgtcagccggttcccaaaggcgtggcagaggatgccgtcttaatcgaaaaggcaagggcgaaatatgctgagttgagttacagcaaaaaaggtttgcagacctttttcctggcaaccctgctgattgcctcgctgctgtcgatttttcttgcactggtcatggcactgtatttcgcccgccgtttcgtcgaacccgtcctatcgcttgccgagggggcgaaggcggtggcgcaaggcgatttcagccagacgcgccccgtgttgcgcaacgacgagttcggacgcttgaccaagttgttcaaccacatgaccgagcagctttccatcgccaaagaagcagacgagcgcaaccgccggcgcgaggaagccgccagacattatctcgaatgcgtgttggaggggctgaccacgggcgtggtggtgtttgacgaacaaggctgtctgaaaaccttcaacaaagcggcggaacagattttggggatgccgcttacccccctgtggggcagcagccggcacggttggcacggcgtttcggcgcagcagtccctgcttgccgaagtgtttgccgccatcggcgcggcggcaggtacggacaaaccggtccatgtgaaatatgccgcgccggacgatgccaaaatcctgctgggcaaggcaaccgtcctgcccgaagacaacggcaacggcgtggtaatggtgattgacgacatcaccgttttgatacacgcgcaaaaagaagccgcgtggggcgaagtggcaaaacggctggcacacgaaatccgcaatccgctcacgcccatccagctttctgccgaacggctggcgtggaaattgggcgggaagctggacgagcaggacgcgcaaatcctgacacgttcgaccgacaccatcatcaaacaagtggcggcattaaaagaaatggtcgaggcattccgcaattacgcgcgttccccttcgctcaaattggaaaatcaggatttgaacgccttaatcggcgatgtgttggcattgtacgaagctggtccgtgccggtttgcggcggaacttgccggcgaaccgctgatgatggcggcggatacgaccgccatgcggcaggtgctgcacaatattttcaaaaatgccgccgaagcggcggaagaagccgatgtgcccgaagtcagggtaaaatcggaagcggggcaggacggacggattgtcctgacagtttgcgacaacggcaaggggttcggcagggaaatgctgcacaatgccttcgagccgtatgtaacggacaaaccggctggaacgggattgggactgcccgtggtgaaaaaaatcattgaagaacacggcggccgcatcagcctgagcaatcaggatgcgggcggcgcgtgtgtcagaatcatcttgccaaaaacggtagaaacttatgcgtag

SEQ ID NO: 1028 - protein, 706 aa, Neisseria meningitidis
MRRFLPIAAICAVVLLYGLTAATGSTSSLADYFWWIVAFSAMLLLVLSAVLARYVILLLKDRRDGVFGSQIAKRLSGMFTLVAVLPGVFLFGVSAQFINGTINSWFGNDTHEALERSLNLSKSALNLAADNALGNAIPVQIDLIGAASLPGDMGRVLEHYAGSGFAQLALYNAASGKIEKSINPHKLDQPFPGKARWEKIQQAGSVRDLESIGGVLYAQGWLSAGTHNGRDYALFFRQPVPKGVAEDAVLIEKARAKYAELSYSKKGLQTFFLATLLIASLLSIFLALVMALYFARRFVEPVLSLAEGAKAVAQGDFSQTRPVLRNDEFGRLTKLFNHMTEQLSIAKEADERNRRREEAARHYLECVLEGLTTGVVVFDEQGCLKTFNKAAEQILGMPLTPLWGSSRHGWHGVSAQQSLLAEVFAAIGAAAGTDKPVHVKYAAPDDAKILLGKATVLPEDNGNGVVMVIDDITVLIHAQKEAAWGEVAKRLAHEIRNPLTPIQLSAERLAWKLGGKLDEQDAQILTRSTDTIIKQVAALKEMVEAFRNYARSPSLKLENQDLNALIGDVLALYEAGPCRFAAELAGEPLMMAADTTAMRQVLHNIFKNAAEAAEEADVPEVRVKSEAGQDGRIVLTVCDNGKGFGREMLHNAFEPYVTDKPAGTGLGLPVVKKIIEEHGGRISLSNQDAGGACVRIILPKTVETYA

SEQ ID NO: 1029 - DNA, 651 bp, Neisseria gonorrhoeae
atgatgatgcacgcttctgtccaaagtcgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggtgcgttcaaaggctaaggcagaaaagttctaccgcgaaaaaatgatacagaacgaaagcatacaccccgtcctgcacgcttctttgcaacacttggaacacaagccgcaaatgctcgccctgctggtcaaaaaccacggcaaaggcatggcggaacaggtcaggttcaaggcggaagtgctgcccgacgacgaagacgcgcgcacgattgccgccgagttggcaaaaatggatatgttcgcattggggacggacgcggtcgcctcgggcgaaacctatgggcgcgtgttcgccgatattttcgagttgtcggcggctttggaaaggcgcgcgttcaaagggatactgaaactgacggcggaatataaaaaacatcttcggcgatgcctgccgttcggaaacggcgttggatttgggcgcgctcaatcaggcgttgagggaaatctcgaaaacgccggaaaagcctaa

SEQ ID NO: 1030 - protein, 216 aa, Neisseria gonorrhoeae
MMMHASVQSRFAPILYVLIFFAGFLTAQIWFNQKAYTEELPPLLSALSAVALVWLAWAFVSVRSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALERRAFKGILKLTAEYKKHLRRCLPFGNGVGFGRAQSGVEGNLENAGKA

SEQ ID NO: 1031 - DNA, 641 bp, Neisseria meningitidis
atgatgatgcacgcttctgtccaaagccgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggcgcgttcaaaggccaaggcggaaaagttctaccgcgaaaaaatgatacagaacgaaagcatacaccccgtcstgcacgcctctttgcaacacttggaacacaagccgcaaatactcgccctgctggtcaaaaaccacggcaaagggatggcggaacaggtcaggttcaaggcggaagtgctgcccgacgacgaagacgcgcgcacgattgccgccgagttggcaaaaatggatatgttcgcattggggackgacgcggtcgcctcgggcgaaacctatggacgcgtgttcgccgatattttcgagttgtcggmggctttggaagggcgcgcgttcaaaggaatgttgaaactgacggcggaatataaaaacatcttcggmgatgcctgccgttcggaaacggcgttggagttgggcgcactcaatcaggcgttgcaggagatttcaaaaacatccgg

SEQ ID NO: 1032 - protein, 214 aa, Neisseria meningitidis
  misc_feature (86)..(86): Xaa can be any naturally occurring amino acid
  misc_feature (166)..(166): Xaa can be any naturally occurring amino acid
  misc_feature (185)..(185): Xaa can be any naturally occurring amino acid
MMMHASVQSRFAPILYVLIFFAGFLTAQIWFNQKAYTEELPPLLSALSAVALVWLAWAFVSARSKAKAEKFYREKMIQNESIHPVXHASLQHLEHKPQILALLVKNHGKGMAEQVRFKAEVLPDDEDARTIAAELAKMDMFALGTDAVASGETYGRVFADIFELSXALEGRAFKGMLKLTAEYKXHLRRCLPFGNGVGVGRTQSGVAGDFKNIR

SEQ ID NO: 1033 - DNA, 650 bp, Neisseria meningitidis
atgatgatgcacgcttctgtccaaagccgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggcgcgttcaaaggctaaggcggaaaagttctaccgcgaaaaaatgatacagaacgaaagcatacaccccgtcctgcacgcttctttgcaacacttggaacacaagccgcaaatgctcgccctgctggtcaaaaaccacggcaaagggatggcggaacaggtcaggttcaaggcggaagtgctgcccgacgacgaagacgcgcgcacgattgccgccgagttggcaaaaatggatatgtttgcattggggacggacgcggtcgcctcgggcgaaacctatggacgcgtgttcgccgatattttcgagttgtcggcggctttggaagggcgcgcgttcaaaggaatgttgaaactgacggcggaatataaaaacatcttcggcgatgcctgccgttcggaaacggcgttggagttgggcgcgctcaatcaggcgttgcaggagatttcaaaaacatcggaaaagtccaa

SEQ ID NO: 1034 - protein, 217 aa, Neisseria meningitidis
  misc_feature (185)..(185): Xaa can be any naturally occurring amino acid
MMMHASVQSRFAPILYVLIFFAGFLTAQIWFNQKAYTEELPPLLSALSAVALVWLAWAFVSARSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALEGRAFKGMLKLTAEYKXHLRRCLPFGNGVGVGRAQSGVAGDFKNIGKVQ

SEQ ID NO: 1035 - DNA, 507 bp, Neisseria gonorrhoeae
atgatgatgcacgcttctgtccaaagtcgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggtgcgttcaaaggctaaggcagaaaagttctaccgcgaaaaaatgatacagaacgaaagcatacaccccgtcctgcacgcttctttgcaacacttggaacacaagccgcaaatgctcgccctgctggtcaaaaaccacggcaaaggcatggcggaacaggtcaggttcaaggcggaagtgctgcccgacgacgaagacgcgcgcacgattgccgccgagttggcaaaaatggatatgttcgcattggggacggacgcggtcgcctcgggcgaaacctatgggcgcgtgttcgccgatattttcgagttgtcggcggctttggaa

SEQ ID NO: 1036 - protein, 169 aa, Neisseria gonorrhoeae
MMMHASVQSRFAPILYVLIFFAGFLTAQIWFNQKAYTEELPPLLSALSAVALVWLAWAFVSVRSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALE

SEQ ID NO: 1037 - DNA, 666 bp, Neisseria meningitidis
atgatgatgcacgcttctgtccaaagccgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggcgcgttcaaaggccaaggcggaaaagttctaccgcgaaaaaatgatacagaacgaaagcatacaccccgtcctgcacgcctctttgcaacacttggaacacaagccgcaaatactcgccctgctggtcaaaaaccacggcaaagggatggcggaacaggtcaggttcaaggcggaagtgctgcccgacgacgaagacgcgcgcacgattgccgccgagttggcaaaaatggatatgttcgcattggggacggacgcggtcgcctcgggcgaaacctatggacgcgtgttcgccgatattttcgagttgtcggcggctttggaagggcgcgcgttcaaaggaatgttgaaactgacggcggaatataaaaacatcttcggcgatgcctgccgttcggaaacggcgttggagttgggcgcactcaatcaggcgttgcaggagatttcaaaaacatcggaaaagtccaaacggatattttattga

SEQ ID NO: 1038 - protein, 221 aa, Neisseria meningitidis
MMMHASVQSRFAPILYVLIFFAGFLTAQIWFNQKAYTEELPPLLSALSAVALVWLAWAFVSARSKAKAEKFYREKMIQNESIHPVLHASLQHLEHKPQILALLVKNHGKGMAEQVRFKAEVLPDDEDARTIAAELAKMDMFALGTDAVASGETYGRVFADIFELSAALEGRAFKGMLKLTAEYKNIFGDACRSETALELGALNQALQEISKTSEKSKRIFY

SEQ ID NO: 1039 - DNA, 666 bp, Neisseria meningitidis
atgatgatgcacgcttctgtccaaagccgtttcgcaccgatactttatgttttgattttctttgccggttttttgaccgcgcaaatctggttcaatcagaaagcctatactgaagagctgcctccgcttctgtccgcattgtccgccgtcgcgctggtgtggctggcgtgggcgttcgtgtcggcgcgttcaaaggctaaggcggaaaagttctaccgcgaaaaaatgatacagaacgaaagcatacaccccgtcctgcacgcttctttgcaacacttggaacacaagccgcaaatgctcgccctgctggtcaaaaaccacggcaaagggatggcggaacaggtcaggttcaaggcggaagtgctgcccgacgacgaagacgcgcgcacgattgccgccgagttggcaaaaatggatatgtttgcattggggacggacgcggtcgcctcgggcgaaacctatggacgcgtgttcgccgatattttcgagttgtcggcggctttggaagggcgcgcgttcaaaggaatgttgaaactgacggcggaatataaaaacatcttcggcgatgcctgccgttcggaaacggcgttggagttgggcgcgctcaatcaggcgttgcaggagatttcaaaaacatcggaaaagtccaaacggatattttattga

SEQ ID NO: 1040 - protein, 221 aa, Neisseria meningitidis
MMMHASVQSRFAPILYVLIFFAGFLTAQIWFNQKAYTEELPPLLSALSAVALVWLAWAFVSARSKAKAEKFYREKMIQNESIHPVLHASLQHLEHKPQMLALLVKNHGKGMAEQVRFKAEVLPDDEDARTIAAELAKMDMFALGTDAVASGETYGRVFADIFELSAALEGRAFKGMLKLTAEYKNIFGDACRSETALELGALNQALQEISKTSEKSKRIFY

SEQ ID NO: 1041 - DNA, 582 bp, Neisseria gonorrhoeae
atgggtgcgggtgtagtattcgttgtctttcagccgttcttcagcctgtttcgagcgttgttcgagggcggagtcggtatagtcgagggagcgcacgatgccgctgaatgcgacttcttgtccgaggaatttacccgtatccggatcggtgatgtttttattgattcggtaggtcagataacggcccggttctttcaggcctttggtgtaaaccctggcgcctttggtgtacagcagcctgccttccgggcccgagagcaggcgcggcgcggcagcggtttctttgcgggaaacgatttgcgggtgctgcataaagacgcggtagaagttgacatcgatggcgggaataccgtatccggacacttccttatccggactgattttgacgacggggatgccgtctgtctgttccaagccgaggcgcggttcgccgccaacgtagcgcaacaccaatacctggcccggataaatcaggtcgggattgtggatttgatcccggttcgcgccccacagggggggaccattgccacgggctgtacaggtatttgcccgaaataccccacagggtgtcgccctgtttga

SEQ ID NO: 1042 - protein, 193 aa, Neisseria gonorrhoeae
MGAGVVFVVFQPFFSLFRALFEGGVGIVEGAHDAAECDFLSEEFTRIRIGDVFIDSVGQITARFFQAFGVNPGAFGVQQPAFRAREQARRGSGFFAGNDLRVLHKDAVEVDIDGGNTVSGHFLIRTDFDDGDAVCLFQAEARFAANVAQHQYLARINQVGIVDLIPVRAPQGGTIATGCTGICPKYPTGCRPV

SEQ ID NO: 1043 - DNA, 513 bp, Neisseria meningitidis
atgggtgcgggtatggtattcgttgtctttcggccgttctccagcctgtttcgagcgttgttcgaggacagagtcggtatagtcgagggagcgcacgatgccgctgaatgcgacttcctgcccgaggaatttacccgtatccggatcggtgatgtttttattgattcggtaggtcaggtagcggcccggctctttcaggcctttggtgtaaaccctggtgcctttggtgtacagcagcctgccttccgggcccgagwrcasgcgcggygcggcagcggtttctttgcgggaaacgatttgcggatgccgcataaagatgcggtagaagttgacatcgatggcgggaataccgtatccggacacttccttatccggactcattttgacgacggggatgccgtctgtctgttccaagccgaggcgcggttcgccgtcaacgtggcgcaacaccaatacctggtccggataaatcaggtcgggattgtggatttgatcccggttcgcgtyccacag

SEQ ID NO: 1044 - protein, 171 aa, Neisseria meningitidis
  misc_feature (86)..(87): Xaa can be any naturally occurring amino acid
  misc_feature (90)..(90): Xaa can be any naturally occurring amino acid
MGAGMVFVVFRPFSSLFRALFEDRVGIVEGAHDAAECDFLPEEFTRIRIGDVFIDSVGQVAARLFQAFGVNPGAFGVQQPAFRARXXARXGSGFFAGNDLRMPHKDAVEVDIDGGNTVSGHFLIRTHFDDGDAVCLFQAEARFAVNVAQHQYLVRINQVGIVDLIPVRVPQ

SEQ ID NO: 1045 - DNA, 581 bp, Neisseria meningitidis
atgggtgcgggtatggtattcgttgtctttcggccgttctccagcctgtttcgagcgttgttcgaggacagagtcggtatagtcgagggagcgcacgatgccgctgaatgcgacttcctgcccgaggaatttacccgtatccggatcggtgatgtttttattgattcggtaggtcaggtagcggcccggctctttcaggcctttggtgtaaaccctggtgcctttggtgtacagcagcctgccttccgggcccgagagcaggcgcggcgcggcagcggtttctttgcgggaaacgatttgcgggtgccgcataaagatgcggtagaagttgacatcgatggcgggaataccgtatccggacacttccttatccggactcattttgacgacggggatgccgtctgtctgttccaagccgaggcgcggttcgccgtcaacgtggcgcaacaccaatacctggtccagataaatcaggtcgggattgtggatttgatcccggttcgcgtcccacaggcggccccattgccacgggctgtacaggtatttgcccgaaatgccccacagggtgtcgccctgtttga

SEQ ID NO: 1046 - protein, 193 aa, Neisseria meningitidis
  misc_feature (174)..(174): Xaa can be any naturally occurring amino acid
MGAGMVFVVFRPFSSLFRALFEDRVGIVEGAHDAAECDFLPEEFTRIRIGDVFIDSVGQVAARLFQAFGVNPGAFGVQQPAFRAREQARRGSGFFAGNDLRVPHKDAVEVDIDGGNTVSGHFLIRTHFDDGDAVCLFQAEARFAVNVAQHQYLVQINQVGIVDLIPVRVPQAAXIATGCTGICPKCPTGCRPV

SEQ ID NO: 1047 - DNA, 714 bp, Neisseria gonorrhoeae
atggagcttgggcatatcgtattccttgtgctttgcgcgcgttcagacggcctttttactttccagacattccgccagcccgcgttcgcgcaagatacagctcgggcattcgcggcagccgccgacgatacccttgtagcaggtgtgggtctgttcgcggatgtagtccaacacgcccatttcgtccgccaacgcccacgtttgcgccttggtcaggtacatcagcggcgtgtggatttgaaaatcgtagtccatcgccagattaagggtaacgttcatggatttgacgaacacgccgcggcagtcgggatagcccgaaaaatcggtttcgcacacgcccgcgatgatgtgccggataccctgccctttggcaaaaatggcggcgtaaagcaggaaaagcgcgttacgcccgtccacaaaggtattgggaacgccgttgtcggcggtttcgatggcggcggtttcgatggcggcggtttcgtccatcagggcgttgtgcgtaatctgccgcatcaggctcaaatcgagtacggtttgactgacacccaaatcctgcgcgatccactctgcgcgttccagctcgacggcatggcgttgcccgtatcggaaggtgatggcttggacgttttcgcgcccgtaggtttggattgcctgaatcaggcaggtggtcgaatcctgaccgcccgagaagatgaccaaggctttttggtttga

SEQ ID NO: 1048 - protein, 237 aa, Neisseria gonorrhoeae
MELGHIVFLVLCARSDGLFTFQTFRQPAFAQDTARAFAAAADDTLVAGVGLFADVVQHAHFVRQRPRLRLGQVHQRRVDLKIVVHRQIKGNVHGFDEHAAAVGIARKIGFAHARDDVPDTLPFGKNGGVKQEKRVTPVHKGIGNAVVGGFDGGGFDGGGFVHQGVVRNLPHQAQIEYGLTDTQILRDPLCAFQLDGMALPVSEGDGLDVFAPVGLDCLNQAGGRILTAREDDQGFLV

SEQ ID NO: 1049 - DNA, 699 bp, Neisseria meningitidis
atggagcttgggcatatcgtattccttatggtttgcgcgtgttcagacggcctttttactttccagatattccgccagcccgcgttcgcgcaagatacagctcgggcattcgcggcagccgccgacgatgccgttatagcaggtgtgggtttgctcgcggatatagtccagcacgcccatttcgtccgccaacgcccacgtttgcgccttggtcagatacatcagcggcgtgtggatttgaaaatcatagtccatcgccaaattaagggtaacgttcatcgatttgacaaacacgtcgcggcagtcgggatagccggagaagtcggtttcgcacacgcccgcgatgatgtgccgtatcccctgccctttggcgtaaatcgcggcatagagcaggaaaagcgcgttgcggccgtctacaaaggtattcggaacgccgttttcggcagtttcgatggcggcggtgtcgtccatcagggcattgtgcgtaatctgccgcatcaggctcaagtcgagtacggtttgtttgacgcccaaatcctgcgcaatccagcgggcacgttccagctcgacggcatggcgttgcccgtattggaaagtaatggcttggacgttttcgcgcccgtaggtttggattgcctgaatcaggcaggtggtcgaatcctgaccgcccgaaaagatgaccaaggcttgttggtttga

SEQ ID NO: 1050 - protein, 232 aa, Neisseria meningitidis
MELGHIVFLMVCACSDGLFTFQIFRQPAFAQDTARAFAAAADDAVIAGVGLLADIVQHAHFVRQRPRLRLGQIHQRRVDLKIIVHRQIKGNVHRFDKHVAAVGIAGEVGFAHARDDVPYPLPFGVNRGIEQEKRVAAVYKGIRNAVFGSFDGGGVVHQGIVRNLPHQAQVEYGLFDAQILRNPAGTFQLDGMALPVLESNGLDVFAPVGLDCLNQAGGRILTARKDDQGLLV

SEQ ID NO: 1051 - DNA, 699 bp, Neisseria meningitidis
atggagcttgggcatatcgtattccttatggtttgcgcgtgttcagacggcctttttactttccagatattccgccagcccgcgttcgcgcaagatacagctcgggcattcgcggcagccgccgacgatgccgttatagcaggtgtgggtttgctcgcggatatagtccagcgcgcccatttcgtccgccaacgcccaagtttgcgccttggtcagatacatcagcggcgtgtggatttgaaaatcatagtccatcgccagattaagggtaacgttcatggatttgacaaacacgtcacggcagtcgggatagccggagaagtcggtttcgcacacgcccgcgatgatgtgccgtatcccctgccctttggcgtaaatcgcggcatagagcaggaaaagcgcgttgcggccgtctacaaaggtattcggaacgccgttttcggcagtttcgatggcggcggtgtcgtccatcagggcattgtgcgtaatctgccgcatcaggctcaagtcgagtacggtttgtttgacgcccaaatcctgcgcaatccagcgggcacgttccagctcgacggcatggcgttgcccgtattggaaagtaatggcttggacgttttcgcgcccgtaggtttggattgcctgaatcaggcaggtggtcgaatcctgaccgcccgaaaagatgaccaaggctttttggtttga

SEQ ID NO: 1052 - protein, 232 aa, Neisseria meningitidis
MELGHIVFLMVCACSDGLFTFQIFRQPAFAQDTARAFAAAADDAVIAGVGLLADIVQRAHFVRQRPSLRLGQIHQRRVDLKIIVHRQIKGNVHGFDKHVTAVGIAGEVGFAHARDDVPYPLPFGVNRGIEQEKRVAAVYKGIRNAVFGSFDGGGVVHQGIVRNLPHQAQVEYGLFDAQILRNPAGTFQLDGMALPVLESNGLDVFAPVGLDCLNQAGGRILTARKDDQGFLV

SEQ ID NO: 1053 - DNA, 549 bp, Neisseria gonorrhoeae
atggcacgtttaaccgtacacaccctcgaaaccgcccccgaagccgccaaaccgcgcgtagaggccgtacccaaaaacaacggctttatccccaacctcatcggcgtattggcaaacgcccccgaagctttggcgttttaccaagaagtcggcaagctcaacgccgccaacagcctgaccgccggcgaagtcgaagtgatccggatcatcgccgtccgcaccaaccaatgcagcttctgcgtggcagggcacaccaaactcgcaaccctgaaaaaactcctgtccgagcaatccctcaatgccgcccgcgctttggcggcaggtaaatctgacgatgccaaactcggcgcgcttgccgccttcacccaagccgtaatggcgaaaaaaggcgcagtatccgacgacgaactcaacgccttcctcgaagcgggctacaaccggcagcaggcagtcgaagtcgtaatgggcgtagccttggcaactttgtgcaactacgccaacaacctcgcccaaaccgaaatcaaccccaaattgcaggcatacgcctaa

SEQ ID NO: 1054 - protein, 182 aa, Neisseria gonorrhoeae
MARLTVHTLETAPEAAKPRVEAVPKNNGFIPNLIGVLANAPEALAFYQEVGKLNAANSLTAGEVEVIRIIAVRTNQCSFCVAGHTKLATLKKLLSEQSLNAARALAAGKSDDAKLGALAAFTQAVMAKKGAVSDDELNAFLEAGYNRQQAVEVVMGVALATLCNYANNLAQTEINPKLQAYA

SEQ ID NO: 1055 - DNA, 233 bp, Neisseria meningitidis
gcagcaggcgaatttgacgatgccaaactcggcgcgctcgccgccttcacccaagccgtaatggcgaaaaaaggcgcggtatccgacgaggaactcaaagcatttttcgatgcgggctacaaccagcagcaggcagtcgaagtcgtgatgggcgtasyctggcaaccctgtgcaactacgtcaacaacctcggacaaaccgaaatcaaccccgaattgcaggcttacgcctga

SEQ ID NO: 1056 - protein, 77 aa, Neisseria meningitidis
  misc_feature (52)..(52): Xaa can be any naturally occurring amino acid
  misc_feature (77)..(77): Xaa can be any naturally occurring amino acid
AAGEFDDAKLGALAAFTAVMAKKGAVSDEELKAFFDAGYNQQQAVEVVMGVXLATLCNYVNNLGQTEINPELQAYAX

SEQ ID NO: 1057 - DNA, 549 bp, Neisseria meningitidis
atggcacgtttaaccgtacacaccctcgaaaccgcccccgaagccgccaaagcgcgcgtcgaggcggtacttcaaaacaacggctttatccccaaccttatcggcgtattatcaaacgcccccgaagccttggcgttttaccaagaagtcggcaagctcaacgccgccaacagcctgaccgccggcgaagtcgaagtaatccagattattgccgcccgcaccaaccaatgcggcttctgcgtggcagggcacaccaaactcgcaaccctgaaaaaactcctttccgaacaatccgtcaaagccgcgcgcgctttggcggcaggcgaatttgacgatgctaaactcggcgcgctcgccgcctttacccaagccgtaatggcaaaaaaaggcgcggtatccgacgaggaactcaaagcattttttgatgcgggctacaaccagcagcaggcagtcgaagtcgtgatgggcgtagccttggcaactttgtgcaactacgtcaacaacctcggacaaaccgaaatcaaccccgaattgcaggcttacgcctga

SEQ ID NO: 1058 - protein, 182 aa, Neisseria meningitidis
MARLTVHTLETAPEAAKARVEAVLQNNGFIPNLIGVLSNAPEALAFYQEVGKLNAANSLTAGEVEVIQIIAARTNQCGFCVAGHTKLATLKKLLSEQSVKAARALAAGEFDDAKLGALAAFTQAVMAKKGAVSDEELKAFFDAGYNQQQAVEVVMGVALATLCNYVNNLGQTEINPELQAYA

SEQ ID NO: 1059 - DNA, 687 bp, Neisseria gonorrhoeae
ttgactttaacccgaaaaacccttttcctcctcaccgccgcgttcggcacacactcccttcagacggcatccgccgacgcagtggtcaagccggaaaaactgcacgcctccgccaaccgcagctacaaagtcgccgaattcacgcaaaccggcaacgcctcgtggtacggcggcaggtttcacgggcgcaaaacttccggcggagaccgctacgatatgaacgcctttaccgccgcccacaaaaccctgcccatccccagccatgtgcgcgtaaccaacaccaaaaacggcaaaagcgtcatcgtccgcgtcaacgaccgcggccccttccacggcaaccgcatcatcgacgtatccaaagccgccgcgcaaaaattgggctttgtcagccaagggacggcacacgtcaaaatcgaacaaatcgtcccgggccaatccgcaccggttgccgaaaacaaagacatctttatcgacttgaaatctttcggtacggaacacgaagcacaagcctatctgaaccaagccgcccaaaatttcgccgcttcgtcatcaagcccgaacctctcggttgaaaaacgccgttacgaatacgttgtcaaaatgggcccgtttgcctcgcaggaacgcgccgccgaagccgaagcgcaggcacgcggtatggttcgggcggtactgacctccggttga

SEQ ID NO: 1060 - protein, 228 aa, Neisseria gonorrhoeae
LTLTRKTLFLLTAAFGTHSLQTASADAVVKPEKLHASANRSYKVAEFTQTGNASWYGGRFHGRKTSGGDRYDMNAFTAAHKTLPIPSHVRVTNTKNGKSVIVRVNDRGPFHGNRIIDVSKAAAQKLGFVSQGTAHVKIEQIVPGQSAPVAENKDIFIDLKSFGTEHEAQAYLNQAAQNFAASSSSPNLSVEKRRYEYVVKMGPFASQERAAEAEAQARGMVRAVLTSG

SEQ ID NO: 1061 - DNA, 720 bp, Neisseria meningitidis
ttgactttaacccgaaaaacccttttccttctcaccgccgcattcggcacacactcccttcagacggcatccgccgacgcagtggtcaaggcagaaaaactgcacgcctccgccaaccgcagctacaaagtcgccggaaaacgctacacgccgaaaaaccaagtcgccgaattcacgcaaaccggcaacgcctcgtggtacggcggcaggtttcacgggcgcaaaacttccggcggagaacgatacgatatgaacgcctttaccgccgcccacaaaaccctgcccatccccagctatgtgcgcgtaaccaataccaaaaacggcaaaagcgtcatcgtccgcgtcaacgaccgcggccccttccacggcaaccgcatcatcgacgtatccaaagccgccgcgcaaaaattgggctttgtcaaccaagggacggcacacgtcaaaatcgaacaaatcgtcccgggccaatccgcaccggttgccgaaaacaaagacatctttatcgacttgaaatctttcggtacggaacacgaagcacaagcctatctgaaccaagccgcccaaaacttcgccgtttcgtcatcgggtacgaacctctcggttgaaaaacgccgttacgaatacgtcgtcaaaatgggaccgtttacctcgcaggaacgcgccgccgaagccgaagctcaggcgcgcggtatggttcgggcggtattgaccgccggctga

SEQ ID NO: 1062 - protein, 239 aa, Neisseria meningitidis
LTLTRKTLFLLTAAFGTHSLQTASADAVVKAEKLHASANRSYKVAGKRYTPKNQVAEFTQTGNASWYGGRFHGRKTSGGERYDMNAFTAAHKTLPIPSYVRVTNTKNGKSVIVRVNDRGPFHGNRIIDVSKAAAQKLGFVNQGTAHVKIEQIVPGQSAPVAENKDIFIDLKSFGTEHEAQAYLNQAAQNFAVSSSGTNLSVEKRRYEYVVKMGPFTSQERAAEAEAQARGMVRAVLTAG

SEQ ID NO: 1063 - DNA, 720 bp, Neisseria meningitidis
ttgactttaacccgaaaaacccttttcctcctcaccgccgcattcggcatacattcctttcagacggcatccgccgacgcagtggtcagggcagaaaaactgcacgcctccgccaaccgcagctacaaagtcgccggaaaacgctacacgccgaaaaaccaagtcgccgaattcacgcaaaccggcaacgcctcgtggtacggcggcaggtttcacgggcgcaaaacttccggcggagaacgatacgatatgaacgcctttaccgccgcccacaaaaccctgcccatccccagctatgtgcgcgtaaccaataccaaaaacggcaaaagcgtcatcgtccgcgtcaacgaccgcggccccttccacggcaaccgcatcatcgacgtatccaaagccgccgcgcaaaaattgggctttgtcaaccaagggacggcgcacgtcaaaatcgaacaaatcgtcccgggccaatccgcaccggttgccgaaaacaaagacatcttcatcgacttgaaatctttcggtacggaacacgaagcacaagcctatctgaaccaagccgcccaaaacctggcttcatcggcatcaaacccgaacctctcggttgaaaaacgccgttacgaatacgtcgtcaaaatgggaccgtttgcctcgcaggaacgcgccgccgaggccgaagctcaggcgcgcggtatggttcgggcggtattaaccgccggttga

SEQ ID NO: 1064 - protein, 239 aa, Neisseria meningitidis
LTLTRKTLFLLTAAFGIHSFQTASADAVVRAEKLHASANRSYKVAGKRYTPKNQVAEFTQTGNASWYGGRFHGRKTSGGERYDMNAFTAAHKTLPIPSYVRVTNTKNGKSVIVRVNDRGPFHGNRIIDVSKAAAQKLGFVNQGTAHVKIEQIVPGQSAPVAENKDIFIDLKSFGTEHEAQAYLNQAAQNLASSASNPNLSVEKRRYEYVVKMGPFASQERAAEAEAQARGMVRAVLTAG

SEQ ID NO: 1065 - DNA, 371 bp, Neisseria meningitidis
atgtcggtgattttgccgccgacacgcgccaacgctgctttttcggcttgggcgcggctgatgattttgtcttgtttgttgtgttggtgtgcggcgtgtccgtggtcgtcatcgccgtgtccgtcgtggtgggcgagcgcgggggcggaaatgctcagcagtgcggttgcggcggaggtcaagagaaggtgtttgatgttcatatttttgcctttgtaaatcgtgggttggaaaatgtggatattaataaggtatcaaataaccgtcagccggcggtcaataccgcccgaaccataccgcgcgcctgagcttcggcttcggcggcgcgttcctgcgaggtaaacggtcccattttgacgacgtattcgtaa

SEQ ID NO: 1066 - protein, 123 aa, Neisseria meningitidis
  misc_feature (69)..(69): Xaa can be any naturally occurring amino acid
  misc_feature (103)..(103): Xaa can be any naturally occurring amino acid
MSVILPPTRANAAFSAWARLMILSCLLCWCAACPWSSSPCPSWWASAGAEMLSSAVAAEVKRRCLMFIXFAFVNRGLENVDINKVSNNRQPAVNTARTIPRAXASASAARSCEVNGPILTTYS

SEQ ID NO: 1067 - DNA, 361 bp, Neisseria meningitidis
atgtcggtgattttgccgccgacacgcgccaacgctgctttttcggcttgggcgcggctgatgattttgtcttgtttgctgtgttggtgtgcggcgtgtccgtggtcgtcatcgccgtgtccgtcgtggtgggcgagtgcgggggcggaaatgcccatcagtgcggttgcggcggcggtcaagagaaggcgtttgaagttcatttttgctcctgcgaagtatctggtggtgtttgaaggacgtaaaggcgggacatcaaccggcggttaataccgcccgaaccataccgcgcgcctgagcttcggcctcggcggcgcgttcctgcgaggcaaacggtcccattttgacgacgtattcgtaa

SEQ ID NO: 1068 - protein, 119 aa, Neisseria meningitidis
  misc_feature (76)..(77): Xaa can be any naturally occurring amino acid
MSVILPPTRANAAFSAWARLMILSCLLCWCAACPWSSSPCPSWWASAGAEMPISAVAAAVKRRRLKFIFAPAKYLXXCLKDVKAGHQPAVNTARTIPRAASASAARSCEANGPILTTYS

SEQ ID NO: 1069 - DNA, 347 bp, Neisseria gonorrhoeae
agttcagacggcatcgccgccgacaatgcccaaacagaaagcccatcatgaccgcatccatgtacatccttttggtcttggcactcatctttgccaacgcccccttcctcacgaccagactgttcggcgtggccgcgctcaagcgcaaacatttcggacaccacctgatcgagctggcggcaggtttcgcgctgaccgcctctcttgcctacatcctcgaatcccgtgcgggagcggtacacaatcagggttgggagttttacgccaccgtcgtctgcctgtacctcattttcgccttcccgtgtttcgtgcggcggtatttttggcacacgcgcaacagggaataa

SEQ ID NO: 1070 - protein, 116 aa, Neisseria gonorrhoeae
MQFRRHRRRQCPNRKPIMTASMYILLVLALIFANAPFLTTRLFGVAALKRKHFGHHLIELAAGFALTASLAYILESRAGAVHNQGWEFYATVVCLYLIFAFPCFVRRYFWHTRNRE

SEQ ID NO: 1071 - DNA, 363 bp, Neisseria meningitidis
atgccgttccgcaacgcgttcagacggcatcgccgccgacaacgcctaaacagaaagcccaccatgaccgcatccatgtacatccttttggtcttggcactcatctttgccaacgcccccttcctcacgaccagactgttcggcgtggccrcactcaagcgcaaacatttcggacaccacatgatcgagctggcggcaggtttcgcgctgaccgccgttcttgcctacatcctsgaatcccgtgcaggatcggtacacgatcagggttgggagttttatgccacagtcgtctgcctgtacctgatttttgcgtttccatgttttgtgtggcggtatttttggcacacgcgcaacagggaatag

SEQ ID NO: 1072 - protein, 120 aa, Neisseria meningitidis
  misc_feature (51)..(51): Xaa can be any naturally occurring amino acid
MPFRNAFRRHRRRQRLNRKPTMTASMYILLVLALIFANAPFLTTRLFGVAXLKRKHFGHHMIELAAGFALTAVLAYILESRAGSVHDQGWEFYATVVCLYLIFAFPCFVWRYFWHTRNRE

SEQ ID NO: 1073 - DNA, 363 bp, Neisseria meningitidis
atgccgttccgcaatgcgttcagacggcatcgccgccgacaatgcccaaacagaaagcccgccatgaccgcatccatgtacatccttttgctgcttgccttgatttttgccaacgcccccttcctcacgaccaagctgttcggcatcgtaccgctcaagcgcaaacatttcggacaccacctgatcgagctggcggcaggtttcgcgctgaccgccgttcttgcctacatcctcgaatcccgtgcgggagcggtacacgatcagggttgggagttttacgccaccgtcgtctgcctgtacctgatttttgcgtttccctgtttcgtgtggcggtatttttggcacacgcgcaacagggaatag

SEQ ID NO: 1074 - protein, 120 aa, Neisseria meningitidis
MPFRNAFRRHRRRQCPNRKPAMTASMYILLLLALIFANAPFLTTKLFGIVPLKRKHFGHHLIELAAGFALTAVLAYILESRAGAVHDQGWEFYATVVCLYLIFAFPCFVWRYFWHTRNRE

SEQ ID NO: 1075 - DNA, 384 bp, Neisseria gonorrhoeae
atgcaagtcgccttttttctcgccgtggtattcaaaaatatgggtttccacaatcgcatcggtcgggcaggcctcttcgcagaaaccgcagaagatgcacttggtcaggtcgatgtcgtaacgcttggtgcggcgggtgccgtcttcgcgttcttccgattcgatgttgatcgccattgccggacacaccgcctcgcacaatttacacgcgatgcagcgttcctctccgttcggaaaacggcgttgcgcgtgcagaccgcggaaacgcacggattgcggcgttttctcttcgggaaaataaattgtgtctttgcgggcaaaaaagtttttgagcgttacgcccatgcctttgaccagttcgccaagcagaaaggtttttactaa

SEQ ID NO: 1076 - protein, 127 aa, Neisseria gonorrhoeae
MQVAFFLAVVFKNMGFHNRIGRAGLFAETAEDALGQVDVVTLGAAGAVFAFFRFDVDRHCRTHRLAQFTRDAAFLSVRKTALRVQTAETHGLRRFLFGKINCVFAGKKVFERYAHAFDQFAKQKGFY

SEQ ID NO: 1077 - DNA, 384 bp, Neisseria meningitidis
gtgcaagtcgccttttttctcgccgtggtattcaaaaatatgggtttccacaatcgcatcagtcgggcatgcctcttcgcagaaaccgcagaagatgcacttggtcaggtcgatgtcgtaacgcttggtgcggcgcgtaccgtcttcacgttcttccgattcgatgttaatcgccattgccggacacactgcctcacacaacttacacgcgatacaccgctcttcgccgttcggataccgccgctgcgcgtgcagaccgcggaaacgcacggattgcggcgttttctcttcggggaaataaattgtgtctttgcgggcgaaaaagtttttgagcgttacgcccataccttttaccaattcgccaagcagaaaggtttttactaa

SEQ ID NO: 1078 - protein, 127 aa, Neisseria meningitidis
VQVAFFLAVVFKNMGFHNRISRACLFAETAEDALGQVDVVTLGAARTVFTFFRFDVNRHCRTHCLTQLTRDTPLFAVRIPPLRVQTAETHGLRRFLFGEINCVFAGEKVFERYAHTFYQFAKQKGFY

SEQ ID NO: 1079 - DNA, 384 bp, Neisseria meningitidis
gtgcaagtcgccttttttctcgccgtggtattcaaaaatatgggtttccacaatcgcatcggtcgggcaggcttcttcgcagaaaccgcagaagatgcacttggtcaggtcgatgtcgtaacgcttggtgcggcgcgtgccgtcttcgcgttcttccgattcgatgttgatcgccattgcggggcaaacggcttcacacaatttacacgcgatgcagcgttcctcgccgtttggataacggcgttgcgcgtgcagaccgcggaaacgcacggattgcggcgttttctcttcgggaaaataaatcgtgtctttgcgggcaaaaaagtttttgagcgttacgcccataccttttaccaattcgccaagcagaaaggtttttactaa

SEQ ID NO: 1080 - protein, 127 aa, Neisseria meningitidis
VQVAFFLAVVFKNMGFHNRIGRAGFFAETAEDALGQVDVVTLGAARAVFAFFRFDVDRHCGANGFTQFTRDAAFLAVWITALRVQTAETHGLRRFLFGKINRVFAGKKVFERYAHTFYQFAKQKGFY

SEQ ID NO: 1081 - DNA, 1014 bp, Neisseria gonorrhoeae
atgaaaaaaaatttacccgcactggcattggcaagtatgctgattttgtcgggctgcgaccgtttgggaataggcaacccgttttccggaaaggaaatttcctgcggaagcgaagagactaaagagattttggtcaaactggtccgcgacaatgtcgaaggtgaaaccgtcaaaacttttgacgacgacgcattcaaagaccaagcatttgccgatatcggcatatcgcatatccgcagaatggtcgaacgtttgggcataaccgtcgatgaagtccgaactaccgagaaaaccgacacgtccagcaaactcaaatgtgaagccgcgttaaaactggacgtgcccgacgatgttgtcgattatgccgtcgccgccaaccaatctataggcaacagccataagaaaacgcccgacttttttgaaccctactaccgcaaagaaggcgcgtattatgtcaaaactatttcttacagcgtccagccgacagacgacaaaagcaaaatctttgccgaactcagtcaggcacacgatatcatccatccgctcagcgagctggtgtctatggcactgattaaagagccgttggacaaagcgaaacaaaggaacgaaaaacttgaagcggcagaagccaccgcgcaggaagcgagggaggcagaagaagcggcggcgcaggaggcattgggtcgggagcaggaagccgcccgcgtatccgaatgggaagaacgctacaagctgtcgcgcagcgagttcgagcagttttggaaaggattgcctcaaactgtacagaataagctgcaagcctcgcagaaaacatggaaaagcggtatggacaagatctgtgccaacaatgcgaaagccgaaggtgaaacgccaaacggcataaaagtcagtgagttggcgtgtaaaacggcagaaaccgaagcacgcttggaagagctgcacaaccgtaaaaaagcccttatcgacgaaatggtcagggaagaggacaagaaagaactgccaaagcggctctga

SEQ ID NO: 1082 - protein, 337 aa, Neisseria gonorrhoeae
MKKNLPALALASMLILSGCDRLGIGNPFSGKEISCGSEETKEILVKLVRDNVEGETVKTFDDDAFKDQAFADIGISHIRRMVERLGITVDEVRTTEKTDTSSKLKCEAALKLDVPDDVVDYAVAANQSIGNSHKKTPDFFEPYYRKEGAYYVKTISYSVQPTDDKSKIFAELSQAHDIIHPLSELVSMALIKEPLDKAKQRNEKLEAAEATAQEAREAEEAAAQEALGREQEAARVSEWEERYKLSRSEFEQFWKGLPQTVQNKLQASQKTWKSGMDKICANNAKAEGETPNGIKVSELACKTAETEARLEELHNRKKALIDEMVREEDKKELPKRL

SEQ ID NO: 1083 - DNA, 422 bp, Neisseria meningitidis
  misc_feature (209)..(209): n is a, c, g, or t
atggcactgattaaagagccgttggacaaagtgaaacaaaggaacgaagaacttgaagcggcagaagaagcggcggcgcaggaggcattgggtcgggagcaggaagccgcccgcgtatccgaatgggaagaacgctacaagctgtcgcgcagcagttcgagcagttctggaaaggattgcctcaaaccgtacagaataagctgcaaccntcacagaaaacatggaaaagcgggatggataaaatctgtgccaacaatgcgaaagctgaaggtaaaacgccaaacggcataaaattcagcgaactggcatgcaaaacggcgaaaaccgaagcacgcttggaagagctgcacaaccgtaaaaaagcccttatcgacgaaatggycagggaagcggacamgaaagaactgtcaaagcggctstga

SEQ ID NO: 1084 - protein, 140 aa, Neisseria meningitidis
  misc_feature (51)..(51): Xaa can be any naturally occurring amino acid
  misc_feature (128)..(128): Xaa can be any naturally occurring amino acid
  misc_feature (133)..(133): Xaa can be any naturally occurring amino acid
MALIKEPLDKVKQRNEELEAAEEAAAQEALGREQEAARVSEWEERYKLSRXQFEQFWKGLPQTVQNKLQPSQKTWKSGMDKICANNAKAEGKTPNGIKFSELACKTAKTEARLEELHNRKKALIDEMXREADXKELSKRL

SEQ ID NO: 1085 - DNA, 423 bp, Neisseria meningitidis
atggcactgattaaagagccgttggacaaagcgaaacaaaggaacgaagaacttgaagcggcagaagaagcggcggcgcaggaggcattgggtcgggagcaggaagtcgaccgcgtatccgaatgggaagaacgctacaagctgtcgcgcagcgagttcgagcagttctggaaaggattgcctcaaaccgtacagaataagctgcaagcctcacagaaaacatggaaaagcgggatggataaaatctgtgccaacaatgcgaaagctgaaggtgaaacgccaaacggcataaaattcagcgaactggcatgcaaaacggcggaaaccgaagcacgcttggaagagctgcacaaccgtaaaaaagcccttctcgacgaaatggccagggaagcggacaagaaagaactgccaaagcggctctga

SEQ ID NO: 1086 - protein, 140 aa, Neisseria meningitidis
MALIKEPLDKAKQRNEELEAAEEAAAQEALGREQEVDRVSEWEERYKLSRSEFEQFWKGLPQTVQNKLQASQKTWKSGMDKICANNAKAEGETPNGIKFSELACKTAETEARLEELHNRKKALLDEMAREADKKELPKRL

SEQ ID NO: 1087 - DNA, 477 bp, Neisseria meningitidis
gtgcaatcccgatatgatggtttgcataaatttaaacatatatgttccgcagctatggcactgattaaagagccgttggacaaagtgaaacaaaggaacgaagaacttgaagcggcagaagaagcggcggcgcaggaggcattgggtcgggagcaggaagccgcccgcgtatccgaatgggaagaacgctacaagctgtcgcgcagcgagttcgagcagttctggaaaggattgcctcaaaccgtacagaataagctgcaagcctcacagaaaacatggaaaagcgggatggataaaatctgtgccaacaatgcgaaagctgaaggtaaaacgccaaacggcataaaattcagcgaactggcatgcaaaacggcgaaaaccgaagcacgcttggaagagctgcacaaccgtaaaaaagcccttatcgacgaaatggccagggaagcggacaagaaagaactgtcaaagcggctctga

SEQ ID NO: 1088 - protein, 158 aa, Neisseria meningitidis
VQSRYDGLHKFKHICSAAMALIKEPLDKVKQRNEELEAAEEAAAQEALGREQEAARVSEWEERYKLSRSEFEQFWKGLPQTVQNKLQASQKTWKSGMDKICANNAKAEGKTPNGIKFSELACKTAKTEARLEELHNRKKALIDEMAREADKKELSKRL

SEQ ID NO: 1089 - DNA, 477 bp, Neisseria meningitidis
gtgcaatcccgatatgatggtttgcataaatttaaacatatatgttccgcagctatggcactgattaaagagccgttggacaaagcgaaacaaaggaacgaagaacttgaagcggcagaagaagcggcggcgcaggaggcattgggtcgggagcaggaagtcgaccgcgtatccgaatgggaagaacgctacaagctgtcgcgcagcgagttcgagcagttctggaaaggattgcctcaaaccgtacagaataagctgcaagcctcacagaaaacatggaaaagcgggatggataaaatctgtgccaacaatgcgaaagctgaaggtgaaacgccaaacggcataaaattcagcgaactggcatgcaaaacggcggaaaccgaagcacgcttggaagagctgcacaaccgtaaaaaagcccttctcgacgaaatggccagggaagcggacaagaaagaactgccaaagcggctctga

SEQ ID NO: 1090 - protein, 158 aa, Neisseria meningitidis
VQSRYDGLHKFKHICSAAMALIKEPLDKAKQRNEELEAAEEAAAQEALGREQEVDRVSEWEERYKLSRSEFEQFWKGLPQTVQNKLQASQKTWKSGMDKICANNAKAEGETPNGIKFSELACKTAETEARLEELHNRKKALLDEMAREADKKELPKRL

SEQ ID NO: 1091 - DNA, 366 bp, Neisseria gonorrhoeae
atggtttggcgtgtgaattgcgcggcaacggcggcgctgattttttcgtccagcccttggatttgggcggtggtgtgggtgtggtcgcggtcggctttttcctgcaaaccttgcgccagccttgacgcgtccagtgcgccggcgttggcggtttcgccgtgggactttatccggaacacggcttcgcccaaggtgtcggcggctttgatgcacagttttaaaaccagggctttggggcggttttctgcgccgcccgttgccattttgctgtccaatcgcggggttaaaaaaccgttgtcgtttaagtcgccgtccgtccaagtcgatacgagcgcgcttctttgcctttcattgcggtcttcgtaa

SEQ ID NO: 1092 - protein, 121 aa, Neisseria gonorrhoeae
MVWRVNCAATAALIFSSSPWIWAVVWVWSRSAFSCKPCASLDASSAPALAVSPWDFIRNTASPKVSAALMHSFKTRALGRFSAPPVAILLSNRGVKKPLSFKSPSVQVDTSALLCLSLRSS

SEQ ID NO: 1093 - DNA, 363 bp, Neisseria meningitidis
atggtttggcgtgtgaattgcgcggcaacggcggtgctgattttttcgtccagcccttggatttgggcggcggtgtgggtgtggtctcggtcggctttgtcttgcaaaccttgcgccacgtgcccgcgtccagcgcctgcgttgatggtttcgccgtgggactttatccaaaacacggcttcgcccaaggtgtcggcggctttgatgcacagttttaaaaccagggctttggggcggttttcgtcgccgcctgtcgccattttgctgtccgagcgcggggttaaaaagccgttgtcgtttaaattttcgtccgtccaagtcgatacgagcgcgcttctctgcctttcgttgcggtcttcgtaa

SEQ ID NO: 1094 - protein, 120 aa, Neisseria meningitidis
MVWRVNCAATAVLIFSSSPWIWAAVWVWSRSALSCKPCATCPRPAPALMVSPWDFIQNTASPKVSAALMHSFKTRALGRFSSPPVAILLSERGVKKPLSFKFSSVQVDTSALLCLSLRSS

SEQ ID NO: 1095 - DNA, 366 bp, Neisseria meningitidis
atggtttggcgtgtgaattgcgcggcaacggcggtgctgattttttcgtccagcccttggatttgggcggcggtgtgggtgtgggcgcggtctgctttgtcttggaggttttgcgccagcgtgcccgcgtccagcgcgccggcgttgacggtttcgccgtgggactttatccagaacacggcttcgcccaaggtgtcggcggctttgatgcacagttttaaaaccagggctttggggcggttttcgtcgccgcctgtcgccattttgctgtccgggcgcggggttaaaaagccgttgtcgtttaaattttcgtccgtccaagtcgatacgagcgcgcttctctgcctttcgttgtggtcttcgtaa

SEQ ID NO: 1096 - protein, 121 aa, Neisseria meningitidis
MVWRVNCAATAVLIFSSSPWIWAAVWVWARSALSWRFCASVPASSAPALTVSPWDFIQNTASPKVSAALMHSFKTRALGRFSSPPVAILLSGRGVKKPLSFKFSSVQVDTSALLCLSLWSS

SEQ ID NO: 1097 - DNA, 423 bp, Neisseria gonorrhoeae
atgaataaaaaccgcaaattactgcttgccgcactgctgctgactgcctttgccgccttcaagctcgttttgttgcaatggtggcaggcgcagcagccgcaagccgtggcggcgcaatgcgatttgaccgagggttgcacgctgccggacggaagccgtgtccgcgccgccgccgtttcaaccaaaaaaccgtttgatatttatatcgaacacgcgcccgccggcacggaacaggtcagcatcagcttcagtatgaaaaatatggatatgggtttcaaccgctatatgttcgagcggcaaccgtcggggacttggcaggcagcacgcatccgcctgcccgtctgtgtcgaaggcaggcgcgattttacggcggacattacaatcggcagccggacatttcagacggcatttaccgccgaataa

SEQ ID NO: 1098 - protein, 140 aa, Neisseria gonorrhoeae
MNKNRKLLLAALLLTAFAAFKLVLLQWWQAQQPQAVAAQCDLTEGCTLPDGSRVRAAAVSTKKPFDIYIEHAPAGTEQVSISFSMKNMDMGFNRYMFERQPSGTWQAARIRLPVCVEGRRDFTADITIGSRTFQTAFTAE

SEQ ID NO: 1099 - DNA, 422 bp, Neisseria meningitidis
atgaataaaaaccgtaaattactgcttgccgcactgctgctgattgcctttgccgccgtcaagctcgttttgttgcaatggtggcaggcgcacagccgcaagctgtggcggcgcaatgcgatttgaccgagggttgcacgctgccggacggaagccgcgtccgcgccgccgccgtttcaaccaaaaaaccgtttgatatttatatcgaacacgcgcccgccggcacggaacaggtcagcatcagcttcagtatgaaaaatatggatatgggtttcaaccgctatatgttcgagcggcaaccgtcggggacttggcaggcagtacgcatccgcctgcccatctgtgtcgaaggcaggcgcgattttacggcggacattacaatcggcagtcggacatttcagacggcatttaccgccgaataa

SEQ ID NO: 1100 - protein, 140 aa, Neisseria meningitidis
  misc_feature (31)..(31): Xaa can be any naturally occurring amino acid
MNKNRKLLLAALLLIAFAAVKLVLLQWWQAXQPQAVAAQCDLTEGCTLPDGSRVRAAAVSTKKPFDIYIEHAPAGTEQVSISFSMKNMDMGFNRYMFERQPSGTWQAVRIRLPICVEGRRDFTADITIGSRTFQTAFTAE

SEQ ID NO: 1101 - DNA, 423 bp, Neisseria meningitidis
atgaataaaaaccgtaaattactgcttgccgcactgctgctgattgcctttgccgccgtcaagctcgttttgttgcaatggtggcaggcgcagcagccgcaagctgtggcggcgcaatgcgatttgaccgagggttgcacgctgccggacggaagccgcgtccgcgccgccgccgtttcaaccaaaaaaccgtttgatatttatatcgaacacgcgcccgccggcacggaacaggtcagcatcagcttcagtatgaaaaatatggatatgggtttcaaccgctatatgttcgagcggcaaccgtcggggacttggcaggcagtacgcatccgcctgcccatctgtgtcgaaggcaggcgcgattttacggcggacattacaatcggcagccggacatttcagacggcatttaccgccgaataa

SEQ ID NO: 1102 - protein, 140 aa, Neisseria meningitidis
MNKNRKLLLAALLLIAFAAVKLVLLQWWQAQQPQAVAAQCDLTEGCTLPDGSRVRAAAVSTKKPFDIYIEHAPAGTEQVSISFSMKNMDMGFNRYMFERQPSGTWQAVRIRLPICVEGRRDFTADITIGSRTFQTAFTAE

SEQ ID NO: 1103 - DNA, 573 bp, Neisseria gonorrhoeae
atgttcagttcgcggatggcgaggatttgggcgacgggggtaacgttgtgtatggtcagtccgtgtccggcgttgacgaccaagcccaaatcgccggcgaaatgcgcgccgttttggatgcgctcgaactgcctgatttgttcggcgtggctttgtgcgtcggcatatgcgccggtgtgcagctcgacaacgggcgcgccgacatcacgggcggcttggatttgcctgtcgtcggcatcgataaacaaggacacgcgtatgcccgcgtcggtcaggattttggcgaattcggcgattttttcctgttgcgccaatacgtccaaaccgccttcggtcgtgatttcctgccgtttttcaggcacgatgcacacgtcttccggcatcactttaagcgcgttttcgagcatttcttccgtcaacgccatttcaaggttcaggcgcgtgcggatggcgtttttgacggcaaatacatccgcgtctttgatgtggcggcggtcttcgcgcaggtgcatggtaatcaggtctgcaccgtgcgtttcggcaaccagtgccgcctccacggggctgggataa

SEQ ID NO: 1104 - protein, 190 aa, Neisseria gonorrhoeae
MFSSRMARIWATGVTLCMVSPCPALTTKPKSPAKCAPFWMRSNCLICSAWLCASAYAPVCSSTTGAPTSRAAWICLSSASINKDTRMPASVRILANSAIFSCCANTSKPPSVVISCRFSGTMHTSSGITLSAFSSISSVNAISRFRRVRMAFLTANTSASLMWRRSSRRCMVIRSAPCVSATSAASTGLG

SEQ ID NO: 1105 - DNA, 573 bp, Neisseria meningitidis
awgttcagttcgcggatggcgaggatttgggcgatgggggtaacgttgtgtatggtcagtccgtgtccggcgttgacgaccaagcccaaatcgccggcgaaatgcgcgccgttttggatgcgctcgaactgcctgatttgttcggcgtggctgcgcgcgtcggcatacgcgcctgtgtgcagctcgacaacgggcgcgccgacatcacgggcggcttggatttgcctgtcgtcggcatcgataaacaaagacacgcgtatgcctgcgtcggtcaggattttggtgaacccggcgattttttcctgttgcgccaatacgtccaaaccgccttcggtcgtgatttcctgacgtttttcaggcacgatgcacacgtcttccggcatcactttcaaagcgttttccaacatttcttccgtcaacgccatttcaaggttcaggcgcgtgcggatggcgtttttgacggcaaacacgtccgcgtctttgatgtggcggcggtcttcgcgcaggtgcatggtaatcaaatccgcaccgtgcgtttcggcaaccagtgccgcctccacggggctgggataa

SEQ ID NO: 1106 - protein, 190 aa, Neisseria meningitidis
  misc_feature (1)..(1): Xaa can be any naturally occurring amino acid
  misc_feature (116)..(116): Xaa can be any naturally occurring amino acid
XFSSRMARIWAMGVTLCMVSPCPALTTKPKSPAKCAPFWMRSNCLICSAWLRASAYAPVCSSTTGAPTSRAAWICLSSASINKDTRMPASVRILVNPAIFSCCANTSKPPSVVISXRFSGTMHTSSGITFKAFSNISSVNAISRFRRVRMAFLTANTSASLMWRRSSRRCMVIKSAPCVSATSAASTGLG

SEQ ID NO: 1107 - DNA, 573 bp, Neisseria meningitidis
atgttcagttcgcggatggcgaggatttgggcgatgggggtaacgttgtgtatggtcagtccgtgtccggcgttgacgaccaagcccaaatcgctggcaaaatgcgcgccgttttggatgcgctcgaactgcctgatttgttcggcgtggctgcgcgcgtcggcatacgcgcctgtgtgcagctcgacaacgggcgcgccgacatcacgggcggcttggatttgcctgtcgtcggcatcgataaacaaggacacgcgtatgcccgcgtcggtcaggattttggtgaattcggcaattttgtcttgttgcgccaatacgtccaagccgccttcggtcgtgatttcctgacgtttttccggcacgatgcacacgtcttccggcatcactttaagcgcgttttcgagcatttcttccgtcaacgccatttcaaggttcaggcgcgtgcggatggcgtttttgacagcaaacacgtccgcgtctttgatgtggcggcggtcttcgcgcaggtgcatggtaatcaggtcggcaccgtgcgtttcggcaaccagtgccgcctccacggggctgggataa

SEQ ID NO: 1108 - protein, 189 aa, Neisseria meningitidis
MFSSRMARIWAMGVTLCMVSPCPALTTKPKSLAKCAPFWMRSNCLICSAWLRASAYAPVCSSTTGAPTSRAAWICLSSASINKDTRMPASVRILVNSAILSCCANTSKPPSVVISRFSGTMHTSSGITLSAFSSISSVNAISRFRRVRMAFLTANTSASLMWRRSSRRCMVIRSAPCVSATSAASTGLG

SEQ ID NO: 1109 - DNA, 1113 bp, Neisseria gonorrhoeae
atgactgcaaaggaagaactgttcgcatggctgcgccatatgaacaaaaacaaaggttccgacctgtttgtgacgacccatttcccgcccgctatgaagctggacggcaaaatcacccgcatcacggacgaaccgctgacggcggaaaaatgtatggaaatcgccttttcgattatgagtgcgaagcaggcggaagaattttcatcgaccaacgagtgcaatttcgccatcagcctgccggacaccagccgcttccgcgtcaatgcgatgatacagcgcggtgcgacggcgttggtattccgcgcgattaccagcaagattcccaagtttgaaagcctgaacctgccgccggccttgaaggatgttgcgctgaaaaaacgcgggctggttatttttgtcggcggcaccggctcgggcaaatcgacttcgctcgcctcgcttatcgactaccgcaatgaaaattcgttcggacacatcatcaccatcgaagatccgatcgagtttgtccacgaacacaaaaactgcatcattacccagcgcgaggtcggcgtggacacggaaaactggatggcggcgttgaaaaatacgctgcgtcaggcgccggatgtgatccttatcggcgaaatccgcgaccgtgaaacaatggactacgccatcgcctttgccgaaacggggcatttgtgtatggcgacgctgcacgccaacagcaccaatcaggcgctcgaccgcatcatcaacttcttccccgaggagcggcgcgaacaattgctgacggatttgtcgctcaaccttcaggcgtttatttcgcaacgcctcgttccgcgagacggcggcaagggcagggtggcggcagtcgaggtgctgctcaattcgcccctgatttcggagttgattcacaacggcaacatccatgaaatcaaagaagtgatgaaaaaatccactaccctgggtatgcagaccttcgaccaacacctttaccaattgtatgaaaaaggcgagatttccttgcaggatgccttgaaaaatgccgattccgcacatgatttgcgtttggcggtacagttgcgcagccgcagggcacaaagttccgaccccgatttggaactgctctga

SEQ ID NO: 1110 - protein, 370 aa, Neisseria gonorrhoeae
MTAKEELFAWLRHMNKNKGSDLFVTTHFPPAMKLDGKITRITDEPLTAEKCMEIAFSIMSAKQAEEFSSTNECNFAISLPDTSRFRVNAMIQRGATALVFRAITSKIPKFESLNLPPALKDVALKKRGLVIFVGGTGSGKSTSLASLIDYRNENSFGHIITIEDPIEFVHEHKNCIITQREVGVDTENWMAALKNTLRQAPDVILIGEIRDRETMDYAIAFAETGHLCMATLHANSTNQALDRIINFFPEERREQLLTDLSLNLQAFISQRLVPRDGGKGRVAAVEVLLNSPLISELIHNGNIHEIKEVMKKSTTLGMQTFDQHLYQLYEKGEISLQDALKNADSAHDLRLAVQLRSRRAQSSDPDLELL

SEQ ID NO: 1111 - DNA, 1113 bp, Neisseria meningitidis
  misc_feature (1103)..(1103): n is a, c, g, or t
atgaccgcaaaggaagaactgttcgcatggctgcgccatatgawccaaaacaaaggttccgacctgttcgtgacaacccatttcccgcccgcaatgaagctggacggcaaaatcacccgcatcacggacgaaccgctgacggcggaaaaatgtatggaaatcgccttttcgattatgagtgcgaagcaggcggaagaattttcatcgaccaacgagtgcaacttcgccatcagcctgccggacaccagccgcttccgcgtcaatgcgatgatacagcgcggcgcgacggcgttggtattccgtacgattaccagcaagattcccaagtttgaaagcctgaacctgccgccagtcttgaaggatgtcgcgctgaaaaaacgcgggctggttatttttgtcggcggcaccggctcgggtaaatcgacttcgcttgcctcgcttatcgactaccgcaatgaaaattcgttcggacacatcatcaccatcgaagacccgatcgagtttgtccacgaacacaaaaactgcatcatcacccagcgcgaggtcggcgtggatacggaaaactggatggcggcgttgaaaaacacgctgcgtcaggcgcctgatgtcatccttatcggcgaaatccgtgaccgcgaaacaatggactacgccattgcctttgccgaaacggggcatttgtgtatggcgacgctgcacgccaacagcaccaatcaggcactcgaccgcatcatcaactttttccccgaggagcggcgcgaacaattgctgacggatttgtcgctcaaccttcaggcgtttatttcgcaacgcctcgttccgcgagacggcggcaagggcagggtggcggcagtcgaggtgctgctcaattcgcccctgatttcggagttgattcacaacggcaacatccatgaaatcaaagaagtgatgaaaaaatccactaccctgggtatgcagaccttcgatcaacacctttaccaattgtatgaaaaaggcgatatttccctgcaagaagcattgaaaaatgccgattccgcacacgatttgcgtttggcggtacagttgcgcagccgccgcgcgcaaagttycagccccgatttggnactgctctga

SEQ ID NO: 1112 - protein, 370 aa, Neisseria meningitidis
  misc_feature (15)..(15): Xaa can be any naturally occurring amino acid
  misc_feature (363)..(363): Xaa can be any naturally occurring amino acid
  misc_feature (368)..(368): Xaa can be any naturally occurring amino acid
MTAKEELFAWLRHMXQNKGSDLFVTTHFPPAMKLDGKITRITDEPLTAEKCMEIAFSIMSAKQAEEFSSTNECNFAISLPDTSRFRVNAMIQRGATALVFRTITSKIPKFESLNLPPVLKDVALKKRGLVIFVGGTGSGKSTSLASLIDYRNENSFGHIITIEDPIEFVHEHKNCIITQREVGVDTENWMAALKNTLRQAPDVILIGEIRDRETMDYAIAFAETGHLCMATLHANSTNQALDRIINFFPEERREQLLTDLSLNLQAFISQRLVPRDGGKGRVAAVEVLLNSPLISELIHNGNIHEIKEVMKKSTTLGMQTFDQHLYQLYEKGDISLQEALKNADSAHDLRLAVQLRSRRAQSXSPDLXLL

SEQ ID NO: 1113 - DNA, 1113 bp, Neisseria meningitidis
atgaccgcaaaggaagaactgttcgcatggctgcgccatatgaacaaaaacaaaggttccgacctgttcgtgacgacccatttcccgcccgcaatgaagctggacggcaaaatcacccgcatcacggacgaaccgctgacggcggaaaaatgtatggaaatcgccttttcgattatgagtgcgaagcaggcggaagaattttcatcgaccaacgagtgcaacttcgccatcagtctgccggacaccagccgcttccgcgtcaatgcgatgatacagcgcggtgcgacggcgttggtattccgtgcgattaccagcaagattcccaagtttgaaagcctgaacctgccgccggtcttgaaggatgtcgcgctgaaaaaacgcgggctggttatttttgtcggcggcaccggctcgggcaaatcgacttcgcttgcctcgcttatcgactaccgcaatgaaaattcgttcggacacatcatcaccatcgaagacccgatcgagtttgtccacgaacacaaaaactgcatcatcacccagcgcgaggtcggcgtggatacggaaaactggatggcggcgttgaaaaacacgctgcgtcaggcaccggatgtgattctgatcggcgaaatccgcgaccgcgaaacaatggactacgccattgcttttgccgaaacggggcatttgtgtatggcgacgctgcacgccaacagcaccaatcaggcactcgaccgcatcatcaactttttccccgaggagcggcgcgaacaattgctgacggatttgtcgctcaaccttcaggcatttatttcgcaacgcctcgttccgcgagacggcggcaagggcagggtggcggcagtcgaggtgctgctcaattcgcccctgatttcggagttgattcacaacggcaatatccatgaaatcaaagaagtgatgaaaaaatccactaccctgggtatgcagactttcgaccaacacctttaccaattgtatgaaaaaggcgagatttccttgcaggatgccttgaaaaatgccgattccgcacacgatttgcgtttggcggtacagttgcgcagccgccaggcgcaaagttccggtcccgatttggaactgctctga

SEQ ID NO: 1114 - protein, 370 aa, Neisseria meningitidis
MTAKEELFAWLRHMNKNKGSDLFVTTHFPPAMKLDGKITRITDEPLTAEKCMEIAFSIMSAKQAEEFSSTNECNFAISLPDTSRFRVNAMIQRGATALVFRAITSKIPKFESLNLPPVLKDVALKKRGLVIFVGGTGSGKSTSLASLIDYRNENSFGHIITIEDPIEFVHEHKNCIITQREVGVDTENWMAALKNTLRQAPDVILIGEIRDRETMDYAIAFAETGHLCMATLHANSTNQALDRIINFFPEERREQLLTDLSLNLQAFISQRLVPRDGGKGRVAAVEVLLNSPLISELIHNGNIHEIKEVMKKSTTLGMQTFDQHLYQLYEKGEISLQDALKNADSAHDLRLAVQLRSRQAQSSGPDLELL

SEQ ID NO: 1115 - DNA, 516 bp, Neisseria gonorrhoeae
  misc_feature (368)..(368): n is a, c, g, or t
atgagtcttcaggcggtatttatataccccccaagccgtaccgcacaatacaacgaaaatcaggaaaacggcggtaaagctcataaacagggacaaagcggcaaacacaccgaccgccgtcaggatataggcgtattcgaggccggaactccattcaccgttttcctgccgtttcttgtcgcttttgaaataaaggatgatgccggcaagcagcgcggcagccgcgcccgacattggcattgtgttcattgttgttccttaacggttaaaaacccgcccggccgtgcaaccgttttaaggcgggaaattgcaaaatttgtttgcgggcgcgtgccgctgaaatcaaggcggtttgagaagtgtttccnacgcgcccgccctatgtgccgaaatattatttgtcgctcacctgcaaaatcgccaagaacgcgctttgcggaatttccacgttgcccacttgtttcatacggcgtttgcctgctttttgtttttcaagcagttttttcttacgcgtaa

SEQ ID NO: 1116 - protein, 171 aa, Neisseria gonorrhoeae
  misc_feature (123)..(123): Xaa can be any naturally occurring amino acid
MSLQAVFIYPPSRTAQYNENQENGGKAHKQGQSGKHTDRRQDIGVFEAGTPFTVFLPFLVAFEIKDDAGKQRGSRARHWHCVHCCSLTVKNPPGRATVLRREIAKFVCGRVPLKSRRFEKCFXRARPMCRNIICRSPAKSPRTRFAEFPRCPLVSYGVCLLFVFQAVFSYA

SEQ ID NO: 1117 - DNA, 513 bp, Neisseria meningitidis
atgagtcttcaggcggtatttatatacccmccaagccgtaccgcacaatacaacgaaaatcaggaaaacggcggtaaagctcayaaacagggacaaagcggcaaacacgccgaccgctgtcaggatataggcgtattcaaggccggaactccattccccgttttcctgccgcttcttgtcgcttttgaaataaaggatgatgccggcaagcagcgcggcagccgcgcccgacattagcattgtgttcattgttgttccttaatgcttaaaaacccgcctgtccgtgcaaccgttttaaggcggcaaattgcaaaatttgtttgcgggcgcgtgcccctgaaatcagggcggtttgaggggtgttcccgacgcgccgccctgtgtgccggagttatttgtcgctcacctgcaaaatcgccaagaacgcgctttgcggaatttccacattgcccacttgtttcatacggcgtttacctgccttttgtktwtcaagcagttttttcttacgcgtaa

SEQ ID NO: 1118 - protein, 169 aa, Neisseria meningitidis
  misc_feature (162)..(162): Xaa can be any naturally occurring amino acid
MSLQAVFIYPPSRTAQYNENQENGGKAHKQGQSGKHADRCQDIGVFKAGTPFPVFLPLLVAFEIKDDAGKQRGSRARHHCVHCCSLMLKNPPVRATVLRRQIAKFVCGRVPLKSGRFEGCSRRAALCAGVICRSPAKSPRTRFAEFPHCPLVSYGVYLPFVXQAVFSYA

SEQ ID NO: 1119 - DNA, 513 bp, Neisseria meningitidis
atgagtcttcaggcggtatttgtataccccccaagccgtaccgcacaatacaacgaaaatcaggaaaacggcggtaaagctcataaacagggacaaagcggcaaacacgccgaccgccgtcaggatataggcgtattccagaccggaactccattcaccgttttcctgccgctttttgtcgcttttgaaataaaggatgatgccggcaagcagcgcggcagccgcgcccgacattagcataatgttcattgttgttccttaacggttaaaaacccgcccgtccgtgcaaccgtttttaagaggcggtaaatcacaaagtttgttggcggacgtgctctcttacaatcagggcggtttaaggggcatgatgcactgccccgtgtgccggatattatttgtcgctcacctgcaaaattgccaagaacgcgctttgcgggatttccacattgcccacttgtttcatacggcgtttgcctgctttttgtttttcaagcagttttttcttacgcgtaa

SEQ ID NO: 1120 - protein, 168 aa, Neisseria meningitidis
MSLQAVFVYPPSRTAQYNENQENGGKAHKQGQSGKHADRRQDIGVFQTGTPFTVFLPLFVAFEIKDDAGKQRGSRARHHNVHCCSLTVKNPPVRATVFKRRITKFVGGRALLQSGRFKGHDALPRVPDIICRSPAKLPRTRFAGFPHCPLVSYGVCLLFVFQAVFSYA

SEQ ID NO: 1121 - DNA, 492 bp, Neisseria gonorrhoeae
atggcggggccgatttttgtcgtcatcgccagcgtcgctatgttttttgtcgcgcagcagcacgcgacagatttggttacggacgattattataaggatggcaagcatatcgacatccagcttcatcgggatgaagaagccgtcagacggcatatcggggtgcaggtcctcatttctcccgatatgaatgcggcaaaagtgtttgtcggcggcgagtttgacggcaaacagcctttgaacctgctgctgatgcacccgacccgcaaggcggacgatcaaaccgtcgccctcaagcccgtcggcagcgcgcagaacggcagggcggaatatgaggcggtgttcaaaacccttccgccggccaaccactggtatgtgcgcgtggaggacgcggcaggcgtgtggcgcgtcgagaacaaatggattaccagccagggcaatgcggtcgatttgaccccgatggacaaacttttcaataatgcaggaagcaaataa

SEQ ID NO: 1122 - protein, 163 aa, Neisseria gonorrhoeae
MAGPIFVVIASVAMFFVAQQHATDLVTDDYYKDGKHIDIQLHRDEEAVRRHIGVQVLISPDMNAAKVFVGGEFDGKQPLNLLLMHPTRKADDQTVALKPVGSAQNGRAEYEAVFKTLPPANHWYVRVEDAAGVWRVENKWITSQGNAVDLTPMDKLFNNAGSK

SEQ ID NO: 1123 - DNA, 492 bp, Neisseria meningitidis
atggcggggccgatttttgtcgtcatcgccagcgtcgctatgttttttgtcgcgcagcagcacgcgacagatttggttacggacgattattataaagacggcaaacatatcgacatccagcttcatcgggatgaagaagccgtcagacggcatatcggggtgcaggttctcatttcccccgatatgaatgcggcaaaagtgtttgtcggcggcgagtttgacggcaaacagcctttgaacctgctgctgatgcacccgacccgcaaggcggacgatcaaaccgtcgccctcaagcccgtcggcagcgcgcagaacggcagggcggaatatgaggcggtgttcaaaaccctttcgccgaccaaccactggtatgtgcgcgtggaggacgcggcaggcgtgtggcgcgtcgagaacaaatggattaccagccaaggcaatgcggtcgatttgaccccgatggacaagcttttcaataatactgaaagcaaataa

SEQ ID NO: 1124 - protein, 163 aa, Neisseria meningitidis
MAGPIFVVIASVAMFFVAQQHATDLVTDDYYKDGKHIDIQLHRDEEAVRRHIGVQVLISPDMNAAKVFVGGEFDGKQPLNLLLMHPTRKADDQTVALKPVGSAQNGRAEYEAVFKTLSPTNHWYVRVEDAAGVWRVENKWITSQGNAVDLTPMDKLFNNTESK

SEQ ID NO: 1125 - DNA, 492 bp, Neisseria meningitidis
atggcggggccgatttttgtcgtcatcgccagcgtcgctatgttttttgtcgcgcagcagcacgcgacagatttggttacggacgattattataaagacggcaagcatatcgacatccagcttcatcgggatgaagaagccgtcagacggcatatcggggtgcaggttctcatttcccccgatatgaatgcggcaaaagtgtttgtcggcggcgagtttgacggcaaacagcctttgaacctgctgctgatgcacccgacccgcaaggcggacgatcaaaccgtcgccctcaagcccgtcggcagcgcgcagaacggcagggcggaatatgaggcggtgttcaaaaccctttcgccgaccaaccactggtatgtgcgcgtggaggacgcggcaggcgtgtggcgcgtcgagaacaaatggattaccagccaaggcaatgcggtcgatttgaccccgatggacaaacttttcaataatactgaaagcaaataa

SEQ ID NO: 1126 - protein, 163 aa, Neisseria meningitidis; identical to SEQ ID NO: 1124

SEQ ID NO: 1127 - DNA, 837 bp, Neisseria gonorrhoeae
atgattttgccgccatccatgacgatgatgcggtcggcggattcgacggtggtcaggcggtgggcgacgatgatgccggtgcggttttccatcaggcgttcgagcgcttgttggacgaggcgttcggattcgttgtccaatgcgctggtggcttcgtccaataataatatcggcgcgtctttcaaaatggcgcgggcgatggcgacgcgttgccgctgtccgccggataagttgctgccgttcgatccgatgggctggtgcagtccgagcggggatgcgtcgatcaggctttgcaggttggcggcttggagggcggacaggacttcggcttcgcccgcgtcgggacggctgtatcggacgttttcaaacagggtgtcgtcaaacaggaatacgtcttgggagacgagggcgaattgggcgcgcaggcagtcgagtttgatgtcggcgatgtcgataccgtctatgcagatgttgccggcagacggttcgacaaagcggggcagaaggttgacgacggtggatttgccgctgccggaacgtccgaccagggcgacgcgttcgccttgtctgatgtcgaggttgaagttgtcgagggctttgatgccgtctgaacggtattcgacatcgacgttgcggaagctgatgcgcccttcgacacgctgcggcgcgagcgtgcctttgtcctgttcgggcggggtgtcgagaaatgcacatacgccgtcggcggcgaggaacatcgtctgcatagggatgctgatgttggcaaggcttttgatgggggcgtacatttgcagcatcgcgacgatgaatgccataaattcgccgatggtggtgtag

SEQ ID NO: 1128 - protein, 278 aa, Neisseria gonorrhoeae
MILPPSMTMMRSADSTVVRRWATMMPVRFSIRRSSACWTRRSDSLSNALVASSNNNIGASFKMARAMATRCRCPPDKLLPFDPMGWCSPSGDASIRLCRLAAWRADRTSASPASGRLYRTFSNRVSSNRNTSWETRANWARRQSSLMSAMSIPSMQMLPADGSTKRGRRLTTVDLPLPERPTRATRSPCLMSRLKLSRALMPSERYSTSTLRKLMRPSTRCGASVPLSCSGGVSRNAHTPSAARNIVCIGMLMLARLLMGAYICSIATMNAINSPMVV

SEQ ID NO: 1129 - DNA, 837 bp, Neisseria meningitidis
atgattttgccgtcgtccatcacgatgatgcggtcggccccttcgatggtggtcaggcggtgggcgacgatgatgccggtgcggttttccatcaggcgttcgagcgcctgttggacgaggcgttcggattcgttgtctaatgcgctggtggcttcgtccaataataatatcggcgcgtctttcaaaatggcgcgggcaatggcgacgcgttgccgctgtccgccggataagttgctgccgttcgatccgatgggctggtgcagtccgagcggggagctgtcaatcaggctttgcaggttggcggtttggagggcgaacaggacttcggcttcgcccgcgtcgggacggctgtatcggacgttttcaaacagggtgtcgtcaaacaggaatacgtcttgggagacgagggcgaattgggcgcgcaggcagtcgagtttgatgtcggcgatgtcgataccgtctatgcagatgttgccggcagacggttcgacaaagcggggcagcaggttgacgacggtggatttgccgctgccggaacgtccgaccagggcgacgcgttcgccttgtctgatgtcgaggttgaagttgtcgagggctttgatgccgtctgaacggtattcgacatcgacgttgcggaagctgatgcgcccttcgacacgctgcggtgcgagcgtgcccttgtcctgttcgggcggggtgtcgagaaatgcacatacaccgtcggcggcgaggaacatcgtctgcatagggatgctgatgttggcaaggcttttgatgggggcgtacatttgcagcatcgcgacgatgaatgccataaattcgccgatggtggtgtag

SEQ ID NO: 1130 - protein, 278 aa, Neisseria meningitidis
MILPSSITMMRSAPSMVVRRWATMMPVRFSIRRSSACWTRRSDSLSNALVASSNNNIGASFKMARAMATRCRCPPDKLLPFDPMGWCSPSGELSIRLCRLAVWRANRTSASPASGRLYRTFSNRVSSNRNTSWETRANWARRQSSLMSAMSIPSMQMLPADGSTKRGSRLTTVDLPLPERPTRATRSPCLMSRLKLSRALMPSERYSTSTLRKLMRPSTRCGASVPLSCSGGVSRNAHTPSAARNIVCIGMLMLARLLMGAYICSIATMNAINSPMVV

SEQ ID NO: 1131 - DNA, 837 bp, Neisseria meningitidis
atgattttgccgtcgtccattacgatgatgcggtcggccccttcgatggtggtcaggcggtgggcgacgatgatgccggtgcggttttccatcaggcgttcgagcgcctgttggacgaggcgttcggattcgttgtccaatgcgctggtggcttcgtccaataataatatcggcgcgtctttcaaaatggcgcgggcaatggcaacgcgttgccgctgtccgccggataagttgctgccgttcgatccgatgggctggtgcagtccgagcggtgatgcgtcgatcaggctttgcaggttagcggcttggagggcggataggacttcggcttcgcccgcgtcgggacggctatatcggacgttttcaaacagggtgtcgtcaaacaggaatacgtcttgggagacgagggcaaattgggcgcgcaggcagtcgagtttgatgtcggcgatgtcgataccgtctatgcagatgttgccggcagacggttcgacaaagcggggcagcaggttgacgacggtggatttgccgctgccggaacgtccgaccagggcgacgcgttcgccttgtctgatgtcgaggttgaagccgtcgagggctttgatgccgtccgaacggtattcgacatcgacgttgcggaagctgatgcgcccttcgacacgctgcggtgcgagcgtgcctttgtcctgttcgggcggggtgtcgagaaatgcacatacgccgtcggcggcgaggaacatcgtctgcatagggatgctaatgttggcaaggcttttgatgggggcgtacatttgcagcatcgcgacgatgaatgccataaattcgccgatggtggtgtag

SEQ ID NO: 1132 - protein, 278 aa, Neisseria meningitidis
MILPSSITMMRSAPSMVVRRWATMMPVRFSIRRSSACWTRRSDSLSNALVASSNNNIGASFKMARAMATRCRCPPDKLLPFDPMGWCSPSGDASIRLCRLAAWRADRTSASPASGRLYRTFSNRVSSNRNTSWETRANWARRQSSLMSAMSIPSMQMLPADGSTKRGSRLTTVDLPLPERPTRATRSPCLMSRLKPSRALMPSERYSTSTLRKLMRPSTRCGASVPLSCSGGVSRNAHTPSAARNIVCIGMLMLARLLMGAYICSIATMNAINSPMVV

SEQ ID NO: 1133 - DNA, 669 bp, Neisseria gonorrhoeae
atggtacacgtcgccgtagcttacggtattgccgtccggcgtttttgcccaaacgaggtcatagacgttttccacgccttgcaggtacatcgccaagcgttcgatgccgtaggtaatttcgccgagtacgggcgtgcaatcgataccgccgacttgttggaaataggtaaactgggttacttccatgccgttgagccagacttcccagcccaaaccccacgcaccgagggtggggttttcccagtcgtcttcgacaaagcggatgtcgtggactttgggatcgatgcccaattcgcgcagggagtcgagatagaggtcttggatattggcgggggcgggtttgagggcgacttggaattggtaatagtgttgcaggcggttggggttgtcgccgtagcggccgtctttggggcggcggctgggttggacgtaggcggcaaaccaaggctcggggccgagcgcgcgcaggcaggtggcgggatgggatgtgccggcaccgacttccatgtcgaagggttggatgacggtgcagcctttgtctgcccagaaggtttgcagtttgaagatgatttgttggaaggtaagcatggcttattgttcgataaaataaaggttttattttactgtttccatagccgcttgaatagatttatctcgaagacagcctga

SEQ ID NO: 1134 - protein, 222 aa, Neisseria gonorrhoeae
MVHVAVAYGIAVRRFCPNEVIDVFHALQVHRQAFDAVGNFAEYGRAIDTADLLEIGKLGYFHAVEPDFPAQTPRTEGGVFPVVFDKADVVDFGIDAQFAQGVEIEVLDIGGGGFEGDLELVIVLQAVGVVAVAAVFGAAAGLDVGGKPRLGAERAQAGGGMGCAGTDFHVEGLDDGAAFVCPEGLQFEDDLLEGKHGLLFDKIKVLFYCFHSRLNRFISKTA

SEQ ID NO: 1135 - DNA, 759 bp, Neisseria meningitidis
atgccccgctttgaggacaagctcgtaggcaggcagggcgagggcggcgttttcttcggcaagcaggcgtttggcttgcgcttcgtagtcgttgaactggcgcagcagccagtcggcatcgctgtattcgaagttgtaggtggattgctcgacttcgttttggtggtacacgtcgccgtaggtgacggtgttgccgtcgagcgtttttgcccaaacgaggtcgtagacgttttctacaccttgcaagtacatcgccaagcgttcgatgccgtaggtgatttcgccgagtacgggcgtgcagtcgatgccgccgacttgttggaaataggtaaactgggttacttccatgccgttgagccagacttcccagcccaaaccccacgcgccgagggtggggttttcccagtcgtcttcgacaaagcggatgtcgtggactttgggatcgatgcccaattcgcgcagagagtcgagatagaggtcttggatattggcgggagcgggcttgagggcgacttggaattggtaatagtgttgcaggcggttggggttgtcgccgtagcggccgtctttggggcggcggctgggttggacgtaggcggcaaaccaaggctcggggccgagtgcgcgcaggcaggtggcgggatgggatgtgccggcaccgacttccatgtcgaagggttggatgacggtgcagcctttgtctgcccagaatgtttgcagtttgaagatgatttgttggaaggtaagcatggcttatga

SEQ ID NO: 1136 - protein, 252 aa, Neisseria meningitidis
MPRFEDKLVGRQGEGGVFFGKQAFGLRFVVVELAQQPVGIAVFEVVGGLLDFVLVVHVAVGDGVAVERFCPNEVVDVFYTLQVHRQAFDAVGDFAEYGRAVDAADLLEIGKLGYFHAVEPDFPAQTPRAEGGVFPVVFDKADVVDFGIDAQFAQRVEIEVLDIGGSGLEGDLELVIVLQAVGVVAVAAVFGAAAGLDVGGKPRLGAECAQAGGGMGCAGTDFHVEGLDDGAAFVCPECLQFEDDLLEGKHGL

SEQ ID NO: 1137 - DNA, 759 bp, Neisseria meningitidis
atgccccgctttgaggacaagctcgtaggcaggcagggcgagggcggcgttttcttcggcaagcaggcgtttggcttgcgcttcgtagtcgttgaactggcgcagcagccaatcggcatcgctgtattcgaagttgtaggtggattgttcgacttcgttttggtggtacacgtcgccgtaagttactgtattaccgtccagcgtttttgcccaaacgaggtcatagacgttttccacgccttgcaggtacatcgccaagcgttcgatgccgtaggtgatttcgccgagtacgggggtgcagtcgatgccgccgacttgttggaaataggtgaactgggttacttccataccgttgagccagacttcccagcccaaaccccacgcgccgagggtggggttttcccagtcgtcttcgacaaagcggatgtcgtgcactttggggtcgatgcccaattcgcgcagggagtcgagatagaggtcttggatattggcgggagcgggcttgagggcgacttggaattggtaatagtgttgcaggcggttggggttgtcgccgtagcgaccgtctttggggcggcggctgggttggacgtaggcggcaaaccaaggctcggggccgagtgcgcgcagacaggtggcgggatgggatgtgccggcaccgacttccatgtcgaagggttggatgacggtgcagcctttgtctgcccagaatgtttgcagtttgaagatgatttgttggaaggtaagcatggcttatga

SEQ ID NO: 1138 - protein, 252 aa, Neisseria meningitidis
MPRFEDKLVGRQGEGGVFFGKQAFGLRFVVVELAQQPIGIAVFEVVGGLFDFVLVVHVAVSYCITVQRFCPNEVIDVFHALQVHRQAFDAVGDFAEYGGAVDAADLLEIGELGYFHTVEPDFPAQTPRAEGGVFPVVFDKADVVHFGVDAQFAQGVEIEVLDIGGSGLEGDLELVIVLQAVGVVAVATVFGAAAGLDVGGKPRLGAECAQTGGGMGCAGTDFHVEGLDDGAAFVCPECLQFEDDLLEGKHGL

SEQ ID NO: 1139 - DNA, 512 bp, Neisseria gonorrhoeae
ttgcgtgcaatcacgcccggtgcgattttttcgacaggggcggtcaaagttgtattaatcggacctttgccgtcgataggccgacccaatgcatcgacgacgcgtccgaccaattcgcgtccgaccggcacttctaaaatacggccggtacaggtaaccgtgtcgccttctttaatatgttcgtactcgcccaacactacggcaccgacggagtcgcgctccaggttcatcgccaagcctaaagtgttacccgggaattcgagcatctcaccttgcattgcatctgacaaaccatggatgcgaacgataccgtcagttaccgaaatcaccgtaccacgggtactcacttcggcatttacagacagattttcgatcttggctttaatcagatcgctaatttcagcaggattaagctgcatgaaaactctcctaattcgtcatagtcgtgtacaaagcactcagtttgccttgtacagacaaatccaaaacctgatcacccacttcaactttta

SEQ ID NO: 1140 - protein, 170 aa, Neisseria gonorrhoeae
LRAITPGAIFSTGAVKVVLIGPLPSIGRPNASTTRPTNSRPTGTSKIRPVQVTVSPSLICSYSPNTTAPTESRSRFIAKPKVLPGNSSISPCIASDKPWMRTIPSVTEITVPRVLTSAFTDRFSILALIRSLISAGLSCMKTLLIRHSRVQSTQFALYRQIQNLITHFNF

SEQ ID NO: 1141 - DNA, 660 bp, Neisseria meningitidis
ttgcgcgcaatcacgcccggtgcgattttttcgataggggcggtcaaagttgtattaatcgggcctttgccgtcgataggccgacccaatgcatcaacgacgcgtccgaccagttcgcgtccgaccggcacttccaagatacgaccggtacaggtaaccgtgtcgccttctttaatgtgttcgtactcgcccaacactacggcgccgacggagtcgcgctccaggttcatcgccaagccgaaagtgttacccgggaattcgagcatctcaccttgcattgcatctgacaaaccatggatgcgaacgataccgtcagttaccgaaattaccgtaccacaggtacgcacttcggcatttacagacagattttcgatcttggctttaatcaaatcgctaatttcagcaggattaagctgcatgaaaactctcctaattcgtcatagtcgtgtacaaggcactcaatttgccttgtacagacaaatccaaaacctgatcacccacttcaacttttatgccgccaatcagctccggttcgatttcgacagagattttcagctcgctgtcgaaacgcttattcagcatttgcaccaactcgccgacctgtttgtcggtcaacggataggcactgtaaatgacggcagatttgatatggttgaatga

SEQ ID NO: 1142 - protein, 219 aa, Neisseria meningitidis
LRAITPGAIFSIGAVKVVLIGPLPSIGRPNASTTRPTSSRPTGTSKIRPVQVTVSPSLMCSYSPNTTAPTESRSRFIAKPKVLPGNSSISPCIASDKPWMRTIPSVTEITVPQVRTSAFTDRFSILALIKSLISAGLSCMKTLLIRHSRVQGTQFALYRQIQNLITHFNFYAANQLRFDFDRDFQLAVETLIQHLHQLADLFVGQRIGTVNDGRFDMVE

SEQ ID NO: 1143 - DNA, 660 bp, Neisseria meningitidis
ttgcgcgcaatcacgcccggtgcgattttttcgataggggcggtcaaagttgtattaatcgggcctttgccgtcgataggccgacccaatgcatcaacgacgcgtccgaccagttcgcgtccgaccggcacttccaagatacgaccggtacaggtaaccgtgtcgccttctttaatatgttcgtgctcgcccaacactacggcgccgacggagtcgcgctccaggttcatcgccaagccgaaagtgttacccgggaattcgagcatctcaccttgcattgcatctgacaaaccatggatgcgaacgataccgtcagttaccgaaatcaccgtaccacgggtacgcacttcggcatttacagacagattttcgatcttggctttaatcaaatcgctaatttcagcaggattaagctgcatgaaaactctcctaattcgtcatagtcgtgtacaaggcactcaatttgccttgtacagacaaatccaaaacctgatcacccacttcaacttttatgccgccaatcagctccggttcgatttcgacagagattttcagctcgctgtcgaaacgcttattcagcatttgcgccaactcgccgacctgtttgtcggtcaacggataggcactgtaaatgacggcagatttgatatggttgaatga

SEQ ID NO: 1144 - protein, 219 aa, Neisseria meningitidis
LRAITPGAIFSIGAVKVVLIGPLPSIGRPNASTTRPTSSRPTGTSKIRPVQVTVSPSLICSCSPNTTAPTESRSRFIAKPKVLPGNSSISPCIASDKPWMRTIPSVTEITVPRVRTSAFTDRFSILALIKSLISAGLSCMKTLLIRHSRVQGTQFALYRQIQNLITHFNFYAANQLRFDFDRDFQLAVETLIQHLRQLADLFVGQRIGTVNDGRFDMVE

SEQ ID NO: 1145 - DNA, 459 bp, Neisseria gonorrhoeae
atgacgcggatttgcggctgcttgatttcaacggttttgagtgtttcggcaagtttgtcggcggcgggtttcatcaggctgcaatgggaaggaacggataccggcagcggcagggcgcgtttggctccggcttctttggcggcagccatggtgcgtccgacggcggcggcgttgcctgcaatcacgacttgtccgggcgagttgaagttgacggcttcgaccacttcgccctgtgcggattcggcacaaatctgcctgacctgttcatcttccaaacccaaaatggccgccattgcgcctacgccttgcggtacggcggactgcatcagttcggcgcgcaggcggacgagtttgacggcatcggcaaaatccaatgcttcggcggcgacaagcgcggtgtattcgccgaggctgtgtccggcaacggcggcaggcgttttgccgcccacttccaaatag

SEQ ID NO: 1146 - protein, 152 aa, Neisseria gonorrhoeae
MTRICGCLISTVLSVSASLSAAGFIRLQWEGTDTGSGRARLAPASLAAAMVRPTAAALPAITTCPGELKLTASTTSPCADSAQICLTCSSSKPKMAAIAPTPCGTADCISSARRRTSLTASAKSNASAATSAVYSPRLCPATAAGVLPPTSK

SEQ ID NO: 1147 - DNA, 459 bp, Neisseria meningitidis
ataacgcggatttgcggctgcttgatttcaacggttttcagggcttcggcaagtttgtcggcggcgggtttcatcaggctgcaatgggaaggtacggacacgggcagcggcagggcgcgtttggcaccggcttctttggcggcagccatggcgcgtccgacggcggcggcgttgcctgcaatcacgatttgtccgggtgagttgaagttgacggcttcgaccacttcgctttgggcggcttcggcacaaatggctttaacctgctcatcttccaagccgagaatcgccgccattgcgcccacgccttgcggtacggcggactgcatcagttcggcgcgcaggcgcacgagtttgaccgcgtcggcaaaattcaatgcgccggcggcaacgagtgcggtgtattcgccgaggctgtgtccggcaacggcggcaggcgttttgccgcccgcttctaaatag

SEQ ID NO: 1148 - protein, 152 aa, Neisseria meningitidis
ITRICGCLISTVFRASASLSAAGFIRLQWEGTDTGSGRARLAPASLAAAMARPTAAALPAITICPGELKLTASTTSLWAASAQMALTCSSSKPRIAAIAPTPCGTADCISSARRRTSLTASAKFNAPAATSAVYSPRLCPATAAGVLPPASK

SEQ ID NO: 1149 - DNA, 459 bp, Neisseria meningitidis
  misc_feature (6)..(6): n is a, c, g, or t
  misc_feature (8)..(8): n is a, c, g, or t
  misc_feature (38)..(39): n is a, c, g, or t
  misc_feature (96)..(96): n is a, c, g, or t
  misc_feature (102)..(102): n is a, c, g, or t
  misc_feature (341)..(341): n is a, c, g, or t
  misc_feature (390)..(390): n is a, c, g, or t
  misc_feature (410)..(410): n is a, c, g, or t
atgacncngatttgcggctgcttgatttcaacggtttnnagggcttcggcgagtttgtcggcggcgggtttcatgaggctgcaatgggaaggtacngacacnggcagcggcagggcgcgtttggcgccggcttctttggcggcaagcatagcgcgctcgacggcggcggcattgcctgcaatcacgacttgtccgggcgagttgaagttgacggcttcaaccacttcatcctgtgcggattcggcgcaaatttgttttacctgttcatcttccaagccgagaatcgccgccattgcgcccacgccttgcggtacggcggactgcatcagttcggcgcgcangcgcacgagtttgaccgcgtcggcaaaatccaatgcgccggcggcaacnagtgcggtgtattcgccgangctgtgtccggcaacggcggcaggcgttttgccgcccgcttccgaatag

SEQ ID NO: 1150 - protein, 152 aa, Neisseria meningitidis
  misc_feature (3)..(3): Xaa can be any naturally occurring amino acid
  misc_feature (13)..(13): Xaa can be any naturally occurring amino acid
  misc_feature (114)..(114): Xaa can be any naturally occurring amino acid
  misc_feature (137)..(137): Xaa can be any naturally occurring amino acid
MTXICGCLISTVXRASASLSAAGFMRLQWEGTDTGSGRARLAPASLAASIARSTAAALPAITTCPGELKLTASTTSSCADSAQICFTCSSSKPRIAAIAPTPCGTADCISSARXRTSLTASAKSNAPAATSAVYSPXLCPATAAGVLPPASE

SEQ ID NO: 1151 - DNA, 927 bp, Neisseria gonorrhoeae
atgaaacacctcaaacttacccttattgccgcattgctggccaccgccgcaactgccgcaccccttccggttgtaaccagtttcagcattttaggcgacgtagccaaacaaatcggcggtgagcgcgtagccgtacaaagcctcgtcggagccaaccaagatactcatgcctatcacatgaccagtggcgacattaaaaaaatccgcagtgcaaaactcgtcctgctcaacggcttgggacttgaagccgccgacatccaacgcgccgtcaaacagagcaaagtatcctatgccgaagcgaccaaaggcatccaacccctcaaagccgaagaagaaggcggacaccatcacgaccaccatcacgaccacgatcatgaccacgaaggacaccaccacgaccacggcgaatatgacccccacgtctggaacgaccctgttcttatgtccgactatgcccaaaacgtcgctgaaaccctgataaaggccgatcccgaaggcaaagtttattatcaacaacgcttgggcaactaccaaatgcagcttaaaaaactgcacagcgacgcacaagccgcatttaatgccgtccctgccgccaaacgcaaagtcctgaccgggcacgacgcattttcctacatgggcaaccgctacaacatcagcttcatcgccccgcaaggcgtgagcagcgaagccgagccgtccgccaaacaagtcgccgccatcatccggcaaatcaaacgcgaaggcatcaaagccgtatttaccgaaaatatcaaagacacccgcatggttgaccgcatcgccaaagaaaccggcgtcaacgtcagcggcaaactgtattccgacgcactcggcaacgcgcccgcagacacctacatcggcatgtaccgccacaacgtcgaagccttgaccaacgcgatgaagcaataa

SEQ ID NO: 1152 - protein, 308 aa, Neisseria gonorrhoeae
MKHLKLTLIAALLATAATAAPLPVVTSFSILGDVAKQIGGERVAVQSLVGANQDTHAYHMTSGDIKKIRSAKLVLLNGLGLEAADIQRAVKQSKVSYAEATKGIQPLKAEEEGGHHHDHHHDHDHDHEGHHHDHGEYDPHVWNDPVLMSDYAQNVAETLIKADPEGKVYYQQRLGNYQMQLKKLHSDAQAAFNAVPAAKRKVLTGHDAFSYMGNRYNISFIAPQGVSSEAEPSAKQVAAIIRQIKREGIKAVFTENIKDTRMVDRIAKETGVNVSGKLYSDALGNAPADTYIGMYRHNVEALTNAMKQ

SEQ ID NO: 1153 - DNA, 915 bp, Neisseria meningitidis
atgaaacacctcaaactcacccttattgccgcattgctgaccgcctccgcaactgccgcccccctgccggttgtaaccagcttcagcattttaggcgacgtagccaaacaaatcggcggagagcgcgtatccatacaaagtttggtcggagccaaccaagatacgcacgcctatcatatgaccagtggcgacattaaaaaaatccgcagtgcaaaactcgtcctgctcaacggcttaggacttgaagctgccgatgtgcaacgcgccgtcaaacaaagcaaagtatcctataccgaagcgaccaaaggcatccaacccctcaaagccgaagaagaaggcggacaccatcacgaccacgatcatgaccacgaaggacaccaccatgaccacggcgaatatgacccgcacgtctggaacgaccccgtccttatgtccgcctatgcccaaaacgttgccaaagccctgataaaggccgatcccgaaggcaaagtttattatcaacaacgcttgggcaactaccaaatgcagctcaaaaaactgcacagcgacgcacaagccgcatttaatgccgtccctgctgccaaacgcaaagtcctgaccgggcacgatgccttttcctatatgggcaaacgttaccatatcgaattcatcgccccgcaaggcgtgagcagcgaagccgagccttcggccaaacaagtcgccgccatcatccgacaaatcaaacgcgaaggcatcaaagccgtctttaccgaaaacatcaaggacacccgtatggttgaccgtatcgccaaagaaaccggtgtcaacgtcagcggcaaactgtattccgacgcactcggcaacgcgcccgcagacacctacatcggaatgtaccgccacaacatcaaagccttgaccaacgcgatgaagcaataa

SEQ ID NO: 1154 - protein, 304 aa, Neisseria meningitidis
MKHLKLTLIAALLTASATAAPLPVVTSFSILGDVAKQIGGERVSIQSLVGANQDTHAYHMTSGDIKKIRSAKLVLLNGLGLEAADVQRAVKQSKVSYTEATKGIQPLKAEEEGGHHHDHDHDHEGHHHDHGEYDPHVWNDPVLMSAYAQNVAKALIKADPEGKVYYQQRLGNYQMQLKKLHSDAQAAFNAVPAAKRKVLTGHDAFSYMGKRYHIEFIAPQGVSSEAEPSAKQVAAIIRQIKREGIKAVFTENIKDTRMVDRIAKETGVNVSGKLYSDALGNAPADTYIGMYRHNIKALTNAMKQ

SEQ ID NO: 1155 - DNA, 927 bp, Neisseria meningitidis
atgaaacaccccaaactcacccttatcgccgcattgctgaccactgccgcaactgccgcccccctgccggttgtaaccagcttcagcattttaggcgacgtagccaaacaaatcggcggagagcgcgtatccatacaaagtttggtcggagccaaccaagatacgcacgcctatcatatgaccagcggcgacattaaaaaaatccgcagtgcaaaactcgtcctgattaacggcttaggacttgaagctgccgacatccaacgtgccgtcaaacagagcaaagtatcctatgccgaagcgaccaaaggcatccaacccctcaaagccgaagaagaaggcggacaccatcacgaccacgatcatgaccacgaccatgaccacgaaggacaccaccacgaccacggcgaatatgacccccacgtctggaacgaccccgtccttatgtccgcctatgcccaaaacgtcgccgaagccctgataaaggccgaccccgaaggcaaagtttattatcaacaacgcttgggcaactaccaaatgcagctcaaaaaactgcacagtgacgcacaagccgcatttaatgccgtccctgccgccaaacgcaaagtcctgaccgggcacgatgccttttcctatatgggcaaacgttaccatatcgaattcatcgccccacaaggtgtgagcagcgaagccgagccttcagccaaacaagtcgccgccatcatccgacaaatcaaacgcgaaggcatcaaagccgtatttaccgaaaatatcaaagacacccgcatggttgaccgcatcgccaaagaaaccggtgtcaacgtcagcggcaaactgtattccgacgcactcggcaacgcacccgcagacacctacatcggcatgtaccgccacaacatcaaagccttaaccaacgcgatgaagcaataa

SEQ ID NO: 1156 - protein, 308 aa, Neisseria meningitidis
MKHPKLTLIAALLTTAATAAPLPVVTSFSILGDVAKQIGGERVSIQSLVGANQDTHAYHMTSGDIKKIRSAKLVLINGLGLEAADIQRAVKQSKVSYAEATKGIQPLKAEEEGGHHHDHDHDHDHDHEGHHHDHGEYDPHVWNDPVLMSAYAQNVAEALIKADPEGKVYYQQRLGNYQMQLKKLHSDAQAAFNAVPAAKRKVLTGHDAFSYMGKRYHIEFIAPQGVSSEAEPSAKQVAAIIRQIKREGIKAVFTENIKDTRMVDRIAKETGVNVSGKLYSDALGNAPADTYIGMYRHNIKALTNAMKQ

SEQ ID NO: 1157 - DNA, 828 bp, Neisseria gonorrhoeae
atgcactacgccctcgcatccgtcttctgcctgtccctcagcgccgcacccgtcggcgtattcctcgtcatgcgccgtatgagcctgataggcgacgcattgagccacgccgtcctgcccggtgccgccgtcggctacatgtttgccggcttgagcctgcccgctatgggtgtgggcgggtttgccgccggtatgctgatggcgctgcttgccggactcgtcagccgctttaccaccctgaaagaagatgccaactttgccgccttttacctgagcagcctcgccatcggcgtaatcctcatcagcaaaaacggcagcagcgtcgatttactccacctccttttcggatctgtgcttgccgtcgatattcccgcactgcaactcatcgccgccgtctccggcctcacgctcattacccttgccgtcatctaccgccccctggtgctagaaagcatagacccccttttcctcaagtccgtcaacggcaaaggcgggctttggcacgtcattttcctcatcctcgtcgttatgaacctcgtatccggcttccaagctctcggcatcctgatgtcggtcggaattatgatgctgcccgccattaccgcccgtttatgggcaagaaatatggggacgctcattctgttgtccgtcctcatcgcccttttttgcggtttgatcgggctgctcatttcctaccacatcgaaatcccttccggccccgccatcatcctctgttgcagcgtcctttatcttttttccgtcatactcggcaaagaaggcggcatcttgcccaaatggttcaaaaaccaccgccaccacaccacctga

SEQ ID NO: 1158 - protein, 275 aa, Neisseria gonorrhoeae
MHYALASVFCLSLSAAPVGVFLVMRRMSLIGDALSHAVLPGAAVGYMFAGLSLPAMGVGGFAAGMLMALLAGLVSRFTTLKEDANFAAFYLSSLAIGVILISKNGSSVDLLHLLFGSVLAVDIPALQLIAAVSGLTLITLAVIYRPLVLESIDPLFLKSVNGKGGLWHVIFLILVVMNLVSGFQALGILMSVGIMMLPAITARLWARNMGTLILLSVLIALFCGLIGLLISYHIEIPSGPAIILCCSVLYLFSVILGKEGGILPKWFKNHRHHTT

SEQ ID NO: 1159 - DNA, 792 bp, Neisseria meningitidis
atgcgctacgccctcgcatccgtcttctgcctgtccctcagtgccgcacccgtcggcgtattcctcgtcatgcgccgtatgagcctgataggcgacgcattgagccacgccgtcctgcccggtgccgccgtcggctacatgtttgccggcttgagcctgcccgccatgggtttgggcggcgtagccgcaggcatgctgatggcactgcttgccggactcgtcagccgcttcaccaccctgaaagaagatgccaactttgccgccttttatctcagcagcctcgccatcggcgtagtcctcgtcagcaaaaacgggagcagcgtcgatttgctccacctccttttcggctctgtacttgccgtcgatattcctgccctgcagctcatcgccgccgtctccagcctcacgctcattacccttgccgtcatctaccgcccgctcgtactcgaaagcatcgaccccctgtttctcaaatccgtcggcggcaaaggcgggctttggcacgtcctctttctcgtcctggtcgtcatgaacctcgtatccggctttcaagccctcggcacactcatgtccgtcggactcatgatgctgccagccattaccgcccgcctgtgggcgaagcatatgggcgcactcatcctcctatccgttctgacagccctgctgtgcggcttgagcggactgctcatttcctaccacatcgaaattccttccggtcccgccatcatcctctgttgcagcgtcctttatctcttttccgtcatactcggcaaagaaggcggcattctgacc

SEQ ID NO: 1160 - protein, 264 aa, Neisseria meningitidis
MRYALASVFCLSLSAAPVGVFLVMRRMSLIGDALSHAVLPGAAVGYMFAGLSLPAMGLGGVAAGMLMALLAGLVSRFTTLKEDANFAAFYLSSLAIGVVLVSKNGSSVDLLHLLFGSVLAVDIPALQLIAAVSSLTLITLAVIYRPLVLESIDPLFLKSVGGKGGLWHVLFLVLVVMNLVSGFQALGTLMSVGLMMLPAITARLWAKHMGALILLSVLTALLCGLSGLLISYHIEIPSGPAIILCCSVLYLFSVILGKEGGILT

SEQ ID NO: 1161 - DNA, 828 bp, Neisseria meningitidis
atgcgctacgccctcgcatccgtcttctgcctgtccctcagtgccgcacccgtcggcgtattcctcgtcatgcgccgtatgagcctgataggcgacgcattgagccacgccgtcctgcccggtgccgccgtcggctacatgtttgccggcttaagcctgcccgccatgggtttgggcggcgtagccgcaggtatgctgatggcactgcttgccggactcgtcagccgcttcaccaccctgaaagaagatgccaactttgccgccttttatctcagcagcctcgccatcggtgtagtcctcgtcagcaaaaacggcagcagcgtcgatttgctccacctccttttcggctccgtacttgccgtcgatattcctgccctgcaactcatcgccgccgtatccaccctcacactgcttacccttgccgtcatctaccgcccgctcgtactcgaaagcatcgaccccctgtttctcaaatctgtcggcggcaaaggcgggctttggcacgtcctctttctcgtcctggtcgtcatgaacctcgtatccggctttcaagccctcggcacactcatgtccgtcggacttatgatgctgccagccattaccgcccgcctatgggcgaagcacatgggcgcactcatcctcctatccgttctgacagccctgctgtgcggcttgagcggactgctcatttcctaccacatcgaaattccttccggtcccgccatcatcctctgttgcagcgtcctttatctcttttccgtcatactcggcaaagaaggcggcattctgaccaaatggctcaaaaaccaccgccaccacaccacctga

SEQ ID NO: 1162 - protein, 275 aa, Neisseria meningitidis
MRYALASVFCLSLSAAPVGVFLVMRRMSLIGDALSHAVLPGAAVGYMFAGLSLPAMGLGGVAAGMLMALLAGLVSRFTTLKEDANFAAFYLSSLAIGVVLVSKNGSSVDLLHLLFGSVLAVDIPALQLIAAVSTLTLLTLAVIYRPLVLESIDPLFLKSVGGKGGLWHVLFLVLVVMNLVSGFQALGTLMSVGLMMLPAITARLWAKHMGALILLSVLTALLCGLSGLLISYHIEIPSGPAIILCCSVLYLFSVILGKEGGILTKWLKNHRHHTT

SEQ ID NO: 1163 - DNA, 654 bp, Neisseria gonorrhoeae
atgggattgggtatggaaatcggcaagctgattgtggctcttttggtgctgatcaatccgtttagcgcgttgtcgctttaccttgacctgaccaacggacacagcacgaaggagcgcaggaaggtcgcgcggacggccgccgtcgccgtgtttgccgtgattgcggtatttgcgctgatcggcggtgcgctattgaaggttttgggcatcagcgtcggttcgtttcaggtcggcggcgggattttggtgctgctgatcgccatttcgatgatgaacggcaacgacaatcccgccaagcagaatctcggcgcgcagccggaaacggggcaagcgcgccccgcccgcaatgcaggggcgattgccgtcgtgcccatcgccataccgatcaccatcggtccgggcggtatttcgactgtgattatttatgcttcggcagccaaaacgtacagcgatatcgcgctgattatcgcggccggtttggtggtcagtgcgatttgttatgccattttaatcgttgccgggaaggtcagccgcctgctgggcgcgacggggctgacgattttaaaccgcattatgggtatgatgctggcggcggtatcggtggagattattgtgtcgggactgaaaacgatattcccgcaactggcaggttga

SEQ ID NO: 1164 - protein, 217 aa, Neisseria gonorrhoeae
MGLGMEIGKLIVALLVLINPFSALSLYLDLTNGHSTKERRKVARTAAVAVFAVIAVFALIGGALLKVLGISVGSFQVGGGILVLLIAISMMNGNDNPAKQNLGAQPETGQARPARNAGAIAVVPIAIPITIGPGGISTVIIYASAAKTYSDIALIIAAGLVVSAICYAILIVAGKVSRLLGATGLTILNRIMGMMLAAVSVEIIVSGLKTIFPQLAG

SEQ ID NO: 1165 - DNA, 654 bp, Neisseria meningitidis
atgggattgggcatggaaatcggcaagctgattgtggcttttttggtgctgattaatccgtttagcgcgttgtcgctttaccttgacctgaccaacgggcacagcacgaaggagcgcaggaaggtcgcgcggacggccgccgttgccgtgtttgccgtgattgcggtatttgcgctgatcggcggtacgctgctgaaggttttgggcatcagcgtcggttcgtttcaggtcggcggcgggattttggtgctgctgatcgccatttcgatgatgaacggcaacgacaatcccgccaagcagaatctcggcgcgcagccggaaacggggcaggcgcgccccgcccgcaatgccggagcgattgccgtcgtgcccatcgccataccgatcaccatcggcccgggcggtatttcgaccgtgattatttacgcttcggcggctaaaacatacggcgacatcgcgttgattatcgcggccggtttggtggtcagtgcgatttgttatgccattttaatcgttgccgggaaggtcagccgcctgctgggcgcgacggggctgacgattttaaaccgcattatgggtatgatgctggcggcggtatcggtggagattattgtgtcgggactgaaaacgatattcccgcaactggcaggttga

SEQ ID NO: 1166 - protein, 217 aa, Neisseria meningitidis
MGLGMEIGKLIVAFLVLINPFSALSLYLDLTNGHSTKERRKVARTAAVAVFAVIAVFALIGGTLLKVLGISVGSFQVGGGILVLLIAISMMNGNDNPAKQNLGAQPETGQARPARNAGAIAVVPIAIPITIGPGGISTVIIYASAAKTYGDIALIIAAGLVVSAICYAILIVAGKVSRLLGATGLTILNRIMGMMLAAVSVEIIVSGLKTIFPQLAG

SEQ ID NO: 1167 - DNA, 654 bp, Neisseria meningitidis
atgggattgggcatggaaatcggcaagctgattgtggcttttttggtgctgattaatccgtttagcgcgttgtcgctttaccttgacctgaccaacgggcacagcacgaaggagcgcaggaaggtcgcgcggacggccgccgttgccgtgtttgccgtgattgcggtatttgcgctgatcggcggtacgctgctgaaggttttgggcatcagcgtcggttcgtttcaggtcggcggcggaattttggtgttgctgattgccatttcgatgatgaacggcaacgacaatcccgccaagcagaatctcggcgcgcagccggaaacggggcaggtgcgccccgcccgcaatgccggagcgattgccgtcgtgcccatcgccataccgatcaccatcggcccgggcggtatttcgaccgtgattatttacgcttcggcggctaaaacatacggcgacatcgcgttgattatcgcggccggtttggtggtcagtgcgatttgttatgccattttaatcgttgccgggaaggtcagccgcctgctgggtgcgacggggctgacgattttaaaccgtatcatgggtatgatgctggcggcggtatcggtggagattattgtgtcgggactgaaaatgatattcccgcaactggcaggttga

SEQ ID NO: 1168 - protein, 217 aa, Neisseria meningitidis
MGLGMEIGKLIVAFLVLINPFSALSLYLDLTNGHSTKERRKVARTAAVAVFAVIAVFALIGGTLLKVLGISVGSFQVGGGILVLLIAISMMNGNDNPAKQNLGAQPETGQVRPARNAGAIAVVPIAIPITIGPGGISTVIIYASAAKTYGDIALIIAAGLVVSAICYAILIVAGKVSRLLGATGLTILNRIMGMMLAAVSVEIIVSGLKMIFPQLAG

SEQ ID NO: 1169 - DNA, 429 bp, Neisseria gonorrhoeae
atgaactttgctttatccgtcatcacatttaccctcgcctctttcctgcccgtcccgcctgccggaaccgccgtctttacttggaaagacggcggcggcaacagctattcggatgtgccgaaacagcttcatcccgaccagagccaaatcctcaacctgcggacgctccaaaccaaaccggcggtcaagcccaaacctgccgtcgatacgaatgcggacagtgcgaaggaaaacgaaaaggatatcgccgagaaaaacgggcagcttgaggaagaaaagaaaaaaattgccgaaaccgaacggcagaacaaagaagaaaactgccggatttcaaaaatgaacctgaaggcggtgggaaactcaaatgcgaaaaacaaggatgatttgatccgtaaatacaataacgccgtaaacaaatactgccgttaa

SEQ ID NO: 1170 - protein, 142 aa, Neisseria gonorrhoeae
MNFALSVITFTLASFLPVPPAGTAVFTWKDGGGNSYSDVPKQLHPDQSQILNLRTLQTKPAVKPKPAVDTNADSAKENEKDIAEKNGQLEEEKKKIAETERQNKEENCRISKMNLKAVGNSNAKNKDDLIRKYNNAVNKYCR

SEQ ID NO: 1171 - DNA, 435 bp, Neisseria meningitidis
atgaactttgctttatccgtcattatgttgaccctcgcctctttcctgcccgtcccgcctgccggagccgccgtctttacttggaaggacggcggcggcaacagctattcggatgtaccgaaacagcttcatcccgaccaaagccaaatcttaaacctgcggacgcgccaaaccaaaccggcggtcaaacccgcccaagccgacgcagggaagcgcacagacggcgcggcacaggaaaacaatcccgacactgccgagaaaaaccggcagcttgaggaagaaaagaaaagaattgccgaaaccgaacggcagaacaaagaagaaaactgccggatttcaaaaatgaacctgaaggcggtgggaaattcaaatgcaaaaaacaaggatgatttgattcggaaatacaataacgccgtaaacaaatactgccgttaa

SEQ ID NO: 1172 - protein, 144 aa, Neisseria meningitidis
MNFALSVIMLTLASFLPVPPAGAAVFTWKDGGGNSYSDVPKQLHPDQSQILNLRTRQTKPAVKPAQADAGKRTDGAAQENNPDTAEKNRQLEEEKKRIAETERQNKEENCRISKMNLKAVGNSNAKNKDDLIRKYNNAVNKYCR

SEQ ID NO: 1173 - DNA, 435 bp, Neisseria meningitidis
atgaactttgctttatccgtcattatgttgaccctcgcctctttcctgcccgtcccgcctgccggagccgccgtctttacttggaaggacggcggcggcaacagctattcggatgtaccgaaacagcttcatcccgaccaaagccaaatcttaaacctgcggacgcgccaaaccaaaccggcggtcaaacccgcccaagccgacgcagggaagcgcacagacggcgcggcacaggaaaacaatcccgacactgccgagaaaaaccggcagcttgaggaagaaaagaaaagaattgccgaaaccgaacggcagaacaaagaagaaaactgccggatttcaaaaatgaacctgaaagcggtgggaaattcaaatgcaaaaaacaaggatgatttgattcggaaatacaataacgccgtaaacaaatactgccgttaa

SEQ ID NO: 1174 - protein, 144 aa, Neisseria meningitidis; identical to SEQ ID NO: 1172

SEQ ID NO: 1175 - DNA, 897 bp, Neisseria gonorrhoeae
atgccgtctgaaactcgaaatcggtttcagacggcattggtttacgcggcaggttggggcttagcggtctttgtaacggcattcgcttttgcctgcaaaagagtcgccggctttgcgtttgcctttgaagccttcgccggtttttttgaaactgtctttcttaaagccttctttcttgaaaccttcgccgcgcgttttgccgccgaagccttctttgcccggtttatgatcgccgcgccggccgccggatttcctatcgccccagccgcctttgcctttcggcttgccgcctgcggatttgcgtttgcgggccggctccatgccttcgatggtcagttcgggcagtttgcggttaatgtatttttcgattttgtggactttgacgtattcgttcacttcggcaaacgtaatcgcaatacccgtgcggcctgcgcggccggtgcgcccgatgcggtggacgtagtcttccgcctgtttcggcaggtcgtagtttatgacgtgggtaatggtcggtacgtcaataccgcgtgcggcaacgtcggtggcaaccaaaattttgcagcggcctttacgcaaatccgtcagcgtgcggttgcgccagccctgcggcatatcgccgtgcaggcagttggcggcgaaacctttttcgtacaattcatccgcgatgacttcggtcatcgctttggtggacgtgaaaatcacacattggtcgatgttggcatcgcgcaggatgtggtcgagcaggcggtttttgtggcgcatatcgtcgcagtacaacaactgctcttcgattttgccttggccgtccacgcgttcgacttcgataatttcagagtctttggtcagtttgcgcgccagtttgccgactgcgccgtcccaagtggcggagaacaataa

SEQ ID NO: 1176 - protein, 298 aa, Neisseria gonorrhoeae
MPSETRNRFQTALVYAAGWGLAVFVTAFAFACKRVAGFAFAFEAFAGFFETVFLKAFFLETFAARFAAEAFFARFMIAAPAAGFPIAPAAFAFRLAACGFAFAGRLHAFDGQFGQFAVNVFFDFVDFDVFVHFGKRNRNTRAACAAGAPDAVDVVFRLFRQVVVYDVGNGRYVNTACGNVGGNQNFAAAFTQIRQRAVAPALRHIAVQAVGGETFFVQFIRDDFGHRFGGRENHTLVDVGIAQDVVEQAVFVAHIVAVQQLLFDFALAVHAFDFDNFRVFGQFARQFADCAVPSGGEQ

SEQ ID NO: 1177 - DNA, 1275 bp, Neisseria meningitidis
atgccgtctgaaactcgaaatcggtttcagacggcattggtttatgcggcaggttggggcttagcggtctttgtaacggcgttcgcctttgcctgcaaaagaatcgccggctttgcgtttgcctttgaagccttcgccggtttttttgaaaccgtctctcttaaagccttctttcttgaaaccttcgccgcgcgttttgccgccgaagccttctttgctcggtttatgatcgccgcgccaaccgccggatttacgatcgccccagccgcctttgcctttcggcttgccgcctgcggatttgcgtttgcgggtcggttccatgccttcgatggtcagttcgggcagttttcggttaatgtatttttcgattttgtggactttgacgtattcgttcacttcggcaaacgtaatcgcaatacccgtgcggcctgcgcggccggtgcgcccgatgcggtggacgtagtcttccgcctgtttcggcaggtcgtagttgataacgtgggtaatggtcggtacgtcgataccgcgtgcggcaacatcggtggcaaccaaaattttgcagcggcctttacgcaaatccatcagcgtgcggttgcgccagccttgcggcatatcgccgtgcaggcagtttgcggcgaaacctttttcgtacagttcatccgcaatgacttcggtcatggctttggtggacgtgaaaatcacgcattgatcgatattggcatcgcgcaagatatgatcgagcaggcggtttttgtggcgcatatcgtcgcagtacagcagttgttcttcgattttgccttgatcgtccacgcgttcgacttcgatgatttcagggtctttggtcagtttgcgcgccagtttgccgaccgcgccgtcccaagtggcggagaacaacaaagtctgacggtcgctcggcgttgcttccacgatggtttcgatgtcgtcgataaagcccatatccaacatacggtcggcttcgtccaaaatcagcacttccaaacgttcaaaatcaactttgccgctttgcatcaggtccatcagacggcccggcgtggcgacaatcagatcgaccggtttgctcagggcacgggtttggtagccgaaagacgcgccgccgacgatgctgacggtgcggaaccaacgcatatttttggcatacgccagcgcgtttttctcgacttgagccgccagttcgcgggtcggggtcaacaccaaagcacgcgggcctttgcccggtttttcgctgcgtttggtcagtttttgcaaagtcggtaa

SEQ ID NO: 1178 - protein, 424 aa, Neisseria meningitidis
MPSETRNRFQTALVYAAGWGLAVFVTAFAFACKRIAGFAFAFEAFAGFFETVSLKAFFLETFAARFAAEAFFARFMIAAPTAGFTIAPAAFAFRLAACGFAFAGRFHAFDGQFGQFSVNVFFDFVDFDVFVHFGKRNRNTRAACAAGAPDAVDVVFRLFRQVVVDNVGNGRYVDTACGNIGGNQNFAAAFTQIHQRAVAPALRHIAVQAVCGETFFVQFIRNDFGHGFGGRENHALIDIGIAQDMIEQAVFVAHIVAVQQLFFDFALIVHAFDFDDFRVFGQFARQFADRAVPSGGEQQSLTVARRCFHDGFDVVDKAHIQHTVGFVQNQHFQTFKINFAALHQVHQTARRGDNQIDRFAQGTGLVAERRAADDADGAEPTHIFGIRQRVFLDLSRQFAGRGQHQSTRAFARFFAAFGQFLQSR

SEQ ID NO: 1179 - DNA, 1275 bp, Neisseria meningitidis
atgccgtctgaaactcgaaatcggtttcagacggcattggtttatgcggcaggttggggcttagcggtctttgtaacggcgttcgcctttgcctgcaaaagaatcgccggctttgcgtttgcctttgaagccttcgccggtttttttgaaaccgtctctcttaaagccttctttcttgaaaccttcgccgcgcgttttgccgccgaagccttctttgctcggtttatgatcgccgcgccaaccgccggatttacgatcgccccagccgcctttgcctttcggcttgccgcctgcggatttgcgtttgcgggtcggttccatgccttcgatggtcagttcgggcagttttcggttaatgtatttttcgattttgtggactttgacgtattcgttcacttcggcaaacgtaatcgcaatacccgtgcggcctgcgcggccggtgcgcccgatgcggtggacgtagtcttccgcctgtttcggcaggtcgtagttgataacgtgggtaatggtcggtacgtcgataccgcgtgcggcaacgtcggtggcaaccaaaattttgcagcggcctttgcgcaaatccatcagcgtgcggttgcgccagccttgcggcatatcgccgtgcaggcagttggcggcgaaacctttttcgtacaattcatccgcgatgacttcggtcatggctttggtggacgtgaaaatcacgcattgatcgatgtcggcatcgcgcaagatatgatcgagcaggcggtttttgtggcgcatatcgtcgcagtacagcagttgttcttcgattttgccttggtcgtccacgcgttcgacttcgatgatttcagggtctttggtcagtttgcgcgccagtttgccgaccgcgccgtcccaagtggcggagaacaacaaagtctgacggtcttccggcgtggcttcgacgatggtttcgatgtcgtcgataaagcccatatccaacatacggtcggcttcgtccaaaatcagcacttccaagcgggcgaaatcgactttgccgctttgcatcaagtccatcagacggcccggcgtggcgacaatcagatcgaccggtttgctcagggcgcgggtttggtagccgaacgatgcaccaccgacgatgctgacggtacggaaccaacgcatatttttggcatacgccagcgcgtttttctcgacttgagccgccaattcgcgggtcggcgtcaacaccaacgcgcgcgggcctttgcccggtttttcgctgcgtttggtcagtcgctgcaaagtcggtaa

SEQ ID NO: 1180 - protein, 424 aa, Neisseria meningitidis
MPSETRNRFQTALVYAAGWGLAVFVTAFAFACKRIAGFAFAFEAFAGFFETVSLKAFFLETFAARFAAEAFFARFMIAAPTAGFTIAPAAFAFRLAACGFAFAGRFHAFDGQFGQFSVNVFFDFVDFDVFVHFGKRNRNTRAACAAGAPDAVDVVFRLFRQVVVDNVGNGRYVDTACGNVGGNQNFAAAFAQIHQRAVAPALRHIAVQAVGGETFFVQFIRDDFGHGFGGRENHALIDVGIAQDMIEQAVFVAHIVAVQQLFFDFALVVHAFDFDDFRVFGQFARQFADRAVPSGGEQQSLTVFRRGFDDGFDVVDKAHIQHTVGFVQNQHFQAGEIDFAALHQVHQTARRGDNQIDRFAQGAGLVAERCTTDDADGTEPTHIFGIRQRVFLDLSRQFAGRRQHQRARAFARFFAAFGQSLQSR

SEQ ID NO: 1181 - DNA, 4170 bp, Neisseria gonorrhoeae
atgaccgataccacaccgacagataccgatccgaccgaaaacggcacgcgcaaaatgccgtctgaacaccgccccgccccgccggcaaaaaaacgccgcccgctgctgaagctgtcggcggcactgctgtctgtcctgattttggcagtatgtttcctcggctggatcgccggtacggaagcaggtttgcgcttcgggctgtaccaaatcccgtcctggttcggcgtaaacatttcctcccaaaacctcaaaggcacactgctcgacggcttcgacggcgacaactggtcgatagaaaccgagggggcagaccttaaaatcagccgcttccgcttcgcgtggaaaccgtccgaactgatgcgccgcagcctgcacatcaccgacatctccgccggcgacatcgccatcgtaaccaaaccgactccgcctaaagaagaacgcccgcctcaaggcctgcccgacagcatagacctgcccgccgctgtctatctcgaccgcttcgagacgggcaaaatcagcatgggcaaaacctttgacaaacaaaccgtctatctcgaacgcctcaacgcggcataccgttacgaccgtaaagggcaccgcctcgacctgaaggccgccgacacgccgtggagcagttcgtcggggtcagcctcggtcggcttgaaaaaaccgtttgccctcgataccgccatttacaccaaaggcggattcgaaggcgaaaccatacacagtacggcgcggctgagcggcagcctgaaggatgtgcgcgccgaactgacgatcgacggcggcaatatccgcctctcgggaaaatccgtcatccacccgtttgccgaatcattggataaaacattggaagaagtactggtcaaaggattcaacatcaatccgtccgccttcgtgccttccctgcccgatgccgggctgaatttcgacctgaccgccatcccgtcgttttcagacggcatcgcgctggaaggctcgctcgatttggaaaacaccaaagccggctttgccgaccgcaacggcatccccgtccgtcaggttttgggcggctttgtcatccggcaggacggcacggtgcatatcggcaatacgtccgccgccctgctcggacggggcggcatcaggctgtcgggcaaaatcgacaccgaaaaagacatccttgatttaaatataggcatcaactccgtcggcgcggaagacgtgctgcaaaccgcgttcaaaggcaggttggacggcagcatcggcatcggcggcacgaccgcctcgcccaaaatctcttggcaactcggcaccggcacggcacgcacggacggcagcctccccatcgcaagcgaccccgcaaacgaacagcggaaactggtgttcgacaccgtcaacatctccgccggggaaggcagcctgaccgcgcaaggctatctcgagctgtttaaagaccgcctgctcaagctggacatccgttcccgcgcattcgacccttcgcgcatcgatccgcaatttccggcaggcaatatcaacggttcgattcatcttgccggtgaactggcaaaagagaaatttacgggcaaaatgcgttttttgcccggtacgttcaacggcgtgccgattgccggcagcgccgacattgtttacgagtcccgccaccttccgcgcgccgccgtcgatttgcggttggggcggaacatcgtcaaaacagacggcggcttcggcaaaaaaggcgaccggcttaacctcaatatcaccgcacccgatttatcccgtttcggtttcggactcgcggggtctttaaatgtacgcggacacctttccggcgatttggacggcggcatccgaacctttgaaaccgacctttccggcacggcgcgcaacttacacatcggcaaagcggcagacatccgttcgctcgattttaccctcaaaggctcacccggcacaagccgcccgatgcgcgccgatatcaagggcggccgcctttccctgtcgggcggcgcggcggttgtcgataccgccggcctgacgctggaaggtacgggcgcgcagcaccgcatccgcacacacgccgccatgacgctggacggcaaaccgttcaaactcgatttggacgcttcaggcggcatcaacagggaacttacccgatggaaaggcagcatcggcatcctcgacatcggcggcgcattcaacctcaagctgcaaaaccgtatgacgctcgaagccggtgcggaacacgtggcggcaagtgcggcaaattggcaggcaatgggcggcagcctcaacctgcaacacttttcttgggacaggaaaaccggcatatcggcaaaaggcggcgcacgcggcctgcacatcgccgagttgcacaatttcttcaaaccgcccttcgaacacaatctggttttaaacggcgactgggatgtcgcctacgggcacaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcggacggattaacgccgatttgggcatcggcaacgccttcggcggcaatatggcaaatacaccgctcggcggcaggattacagcctcccttcccgacttgggcgcattgaagccctttctgcccgccgccgcgcaaaacattaccggcagcctgaatgcctccgcgcaaatcggcggacgggtaggctctccgtccgtcaatgccgccgtcaacggtagcagcaactacgggaaaatcaacggcaatatcaccgtcgggcaaagccgctccttcgataccgcacctttgggcggcaggctcaacctgaccgttgccgatgccgaagcattccgcaacttcctaccggtcggacaaaccgtcaaaggcagcctgaatgccgccgtaaccctcggcggcagcatcgccgacccgcacttgggcggcagtatcaacggcgacaagctctattaccgcaaccaaacccaaggcatcatcttggacaacggctcgctgcgttcgcatattgcaggcaggaaatgggtaatcgacagcctgaaattccggcacgaagggacggcggaactctccggcacggtcagcatggaaaacagcgtgcccgatgtcgatatcggcgcggtgttcgacaaataccgcatcctgtcccgccccaaccgccgcctgacggtttccggcaacacccgcctgcgctattcgccgcaaaaaggcatatccgttaccggtatgattaaaactgatcaggggctgttcggttcgcaaaaatcctcgatgccgtccgtcggcgacgatgtcgtcgtattgggcgaagtcaagaaagaggcggcggcatcgctccccgtcaatatgaacctgactttagacctcaatgacggcatccgcttctccggctacggcgcggacgttaccataggcggcaaactgaccctgaccgcgcaaccgggcggaaatgtgcgtggggtgggcacggtccgcgtcatcaaagggcgttacaaagcatacgggcaggatttagacattaccaaaggcacagtctcctttgtcggcccgctcaacgaccccaacctgaacatccgcgccgaacgccgcctttcccccgtcggtgcgggcgtggaaatattgggcagcctcaacagcccgcgcattacgctgacggcaaacgaaccgatgagtgaaaaagacaagctctcctggctcatcctcaaccgtgccggcagcggcagcagcggcgacaatgccgccctgtccgcagccgcaggcgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacggcatctccagcgcggaacagtccgtcaaactgatttaccggctgacccgcgccatacaggcggttgcccgtatcggcagccgttcgtcgggcggcgagctgacatacaccatacgtttcgaccgcctcttcggttcggacaaaaaagactccgcaggaaacggcaaagggaaataa

SEQ ID NO: 1182 - protein, 1389 aa, Neisseria gonorrhoeae
MTDTTPTDTDPTENGTRKMPSEHRPAPPAKKRRPLLKLSAALLSVLILAVCFLGWIAGTEAGLRFGLYQIPSWFGVNISSQNLKGTLLDGFDGDNWSIETEGADLKISRFRFAWKPSELMRRSLHITDISAGDIAIVTKPTPPKEERPPQGLPDSIDLPAAVYLDRFETGKISMGKTFDKQTVYLERLNAAYRYDRKGHRLDLKAADTPWSSSSGSASVGLKKPFALDTAIYTKGGFEGETIHSTARLSGSLKDVRAELTIDGGNIRLSGKSVIHPFAESLDKTLEEVLVKGFNINPSAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGTGTARTDGSLPIASDPANEQRKLVFDTVNISAGEGSLTAQGYLELFKDRLLKLDIRSRAFDPSRIDPQFPAGNINGSIHLAGELAKEKFTGKMRFLPGTFNGVPIAGSADIVYESRHLPRAAVDLRLGRNIVKTDGGFGKKGDRLNLNITAPDLSRFGFGLAGSLNVRGHLSGDLDGGIRTFETDLSGTARNLHIGKAADIRSLDFTLKGSPGTSRPMRADIKGGRLSLSGGAAVVDTAGLTLEGTGAQHRIRTHAAMTLDGKPFKLDLDASGGINRELTRWKGSIGILDIGGAFNLKLQNRMTLEAGAEHVAASAANWQAMGGSLNLQHFSWDRKTGISAKGGARGLHIAELHNFFKPPFEHNLVLNGDWDVAYGHNARGYLNISRQSGDAVLPGGQALGLNAFSLKTRFQNDRIGILLDGGARFGRINADLGIGNAFGGNMANTPLGGRITASLPDLGALKPFLPAAAQNITGSLNASAQIGGRVGSPSVNAAVNGSSNYGKINGNITVGQSRSFDTAPLGGRLNLTVADAEAFRNFLPVGQTVKGSLNAAVTLGGSIADPHLGGSINGDKLYYRNQTQGIILDNGSLRSHIAGRKWVIDSLKFRHEGTAELSGTVSMENSVPDVDIGAVFDKYRILSRPNRRLTVSGNTRLRYSPQKGISVTGMIKTDQGLFGSQKSSMPSVGDDVVVLGEVKKEAAASLPVNMNLTLDLNDGIRFSGYGADVTIGGKLTLTAQPGGNVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYGISSAEQSVKLIYRLTRAIQAVARIGSRSSGGELTYTIRFDRLFGSDKKDSAGNGKGK

SEQ ID NO: 1183 - DNA, 4170 bp, Neisseria meningitidis
atgaccgataccgcaccgacagataccgatccgaccgaaaacggcacgcgcaaaatgccgtctgaacaccgccctaccccgccggcaaaaaaacgccgcccgttgctgaagctgtcggcggcactgctgtctgtcctgattttggcagtatgtttcctcggctggctcgccggtacggaagcaggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgccttgacctgaaggccgccgacacgccgtggagcagttcgtcgggggcggcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccggccgccttcgtgccttccctgcccgatgccggactgaatttcgacctgaccgccatcccgtcgttttcagacggcatcgcgctggaaggttcgctcgatttggaaaacaccaaagccggctttgccgaccgcaacggcatccccgtccgtcaggttttaggcggctttgtcatccggcaggacggcacggtgcatatcggcaatacgtccgccgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgacccagcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggtgatttggacggcggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggcggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgcaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcgggcggattaacgccgatttgggcatcgccaacgccttcggcggcaatatggcaaatgcaccgctcggcggcaggattaccgcctcccttcccgacttgggcgcattgaagccctttctgcccgccgccgcgcaaaacattaccggcagcctgaatgccgccgcgcaaatcggcggacgggtaggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtacggggcgtgggcacggtccgcgtcatcaaagggcgttataaggcatacgggcaggatttggacattaccaaaggcacggtctcctttgtcggcccgctcaacgatcccaacctcaacatccgcgccgaacgccgcctttcccccgtcggtgcgggcgtggaaatattgggcagcctcaacagcccgcgcattacgctgacggcaaacgaaccgatgagtgaaaaagacaagctctcttggctcatcctcaaccgcgccggcagcggcagcagcggcgacaatgccgccctgtctgcagccgcaggtgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacggcaaaggaaaataa

SEQ ID NO: 1184 - protein, 1389 aa, Neisseria meningitidis
MTDTAPTDTDPTENGTRKMPSEHRPTPPAKKRRPLLKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGAASVGLKKPFALDTAIYTKGGLEGKTIHSTARLSGSLKDVRAELAIDGGNIRLSGKSVIHPFAESLDKTLEEVLVKGFNINPAAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAAVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLGIANAFGGNMANAPLGGRITASLPDLGALKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNGKGK

SEQ ID NO: 1185 - DNA, 4170 bp, Neisseria meningitidis
atgaccgataccgcaccgacagataccgatccgaccgaaaacggcacgcgcaaaatgccgtctgaacaccgccctaccccgccggcaaaaaaacgccgcccgctgctgaagctgtcggcggcactgctgtctgttctgattttggcagtatgtttcctcggctggctcgccggcacggaagcgggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgcctcgacctgaaggctgccgacacgccgtggagcagttcgtcggggtcagcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccgtccgccttcgtgccttccctgcccgatgccgggctgaatttcgacctgaccgccatcccgtcgttttcagacggcatcgcgctggaaggctcgctcgatttggaaaacaccaaagccggctttgccgaccgcaacggcatccccgtccgtcaggttttaggcagctttgtcatccggcaggacggcacggtgcatatcggcaatacgtccgtcgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgaccccgcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggcgatttggacggtggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggaggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgaaacgcgcgcggctacctcaatatcagccggcaaagcggcgatgccgtattgcccggcgggcaggctttgggtttgaacgcattttccctgaaaacgcgctttcaaaacgaccgtatcggaatcctgcttgacggcggcgcgcgtttcgggcggattaacgccgatttggacatcggcaacgccttcggcggcaatatggcaaatgcaccgctcggcggcaggattaccgcctcccttcccgacttgggcacattgaagccctttctgcccgccgccgcgcaaaacattaccggcagcctgaatgccgccgcgcaaatcggcggacgggtcggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtgcggggcgtgggcacggtccgcgtcatcaaagggcgttataaggcatacgggcaggatttggacattaccaaaggcacggtctcctttgtcggcccgctcaacgaccccaacctcaacatccgcgccgaacgccgcctttcccccgtcggtgcgggcgtggaaatattgggcagcctcaacagtccgcgcattacgctgacggcaaacgaaccgatgagtgaaaaagacaagctctcctggctcatcctcaaccgcgccggcagtggcagcagcggcgacaatgccgccctgtccgcagccgccggcgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacagcaaaggaaaataa

SEQ ID NO: 1186 - protein, 1389 aa, Neisseria meningitidis
MTDTAPTDTDPTENGTRKMPSEHRPTPPAKKRRPLLKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGSASVGLKKPFALDTAIYTKGGLEGKTIHSTARLSGSLKDVRAELAIDGGNIRLSGKSVIHPFAESLDKTLEEVLVKGFNINPSAFVPSLPDAGLNFDLTAIPSFSDGIALEGSLDLENTKAGFADRNGIPVRQVLGSFVIRQDGTVHIGNTSVALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAEVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLDIGNAFGGNMANAPLGGRITASLPDLGTLKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNSKGK

SEQ ID NO: 1187 - DNA, 4065 bp, Neisseria gonorrhoeae
ctgaagctgtcggcggcactgctgtctgtcctgattttggcagtatgtttcctcggctggatcgccggtacggaagcaggtttgcgcttcgggctgtaccaaatcccgtcctggttcggcgtaaacatttcctcccaaaacctcaaaggcacactgctcgacggcttcgacggcgacaactggtcgatagaaaccgagggggcagaccttaaaatcagccgcttccgcttcgcgtggaaaccgtccgaactgatgcgccgcagcctgcacatcaccgacatctccgccggcgacatcgccatcgtaaccaaaccgactccgcctaaagaagaacgcccgcctcaaggcctgcccgacagcatagacctgcccgccgccgtctatctcgaccgcttcgagacgggcaaaatcagcatgggcaaaacctttgacaaacaaaccgtctatctcgaacgcctcaacgcggcataccgttacgaccgtaaagggcaccgcctcgacctgaaggccgccgacacgccgtggagcagttcgtcggggtcagcctcggtcggcttgaaaaaaccgtttgccctcgataccgccatttacaccaaaggcggattcgaaggcgaaaccatacacagtacggcgcggctgagcggcagcctgaaggatgtgcgcgccgaactgacgatcgacggcggcaatatccgcctctcgggaaaatccgtcatccacccgtttgccgaatcattggataaaacattggaagaagtactggtcaaaggattcaacatcaatccgtccgccttcgtgccttccctgcccgatgccgggctgaatttcgacctgaccgccatcccgtcgttttcagacggcatcgcgctggaaggctcgctcgatttggaaaacaccaaagccggctttgccgaccgcaacggcatccccgtccgtcaggttttgggcggctttgtcatccggcaggacggcacggtgcatatcggcaatacgtccgccgccctgctcggacggggcggcatcaggctgtcgggcaaaatcgacaccgaaaaagacatccttgatttaaatataggcatcaactccgtcggcgcggaagacgtgctgcaaaccgcgttcaaaggcaggttggacggcagcatcggcatcggcggcacgaccgcctcgcccaaaatctcttggcaactcggcaccggcacggcacgcacggacggcagcctcgccatcgcaagcgaccccgcaaacgaacagcggaaactggtgttcgacaccgtcaacatctccgccggggaaggcagcctgaccgcgcaaggctatctcgagctgtttaaagaccgcctgctcaagctggacatccgttcccgcgcattcgacccttcgcgcatcgatccgcaatttccggcaggcgatatcaacggttcgattcatcttgccggtgaactggcaaaagagaaatttacgggcaaaatgcgttttttgcccggtacgttcaacggcgtgccgattgccggcagcgccgacattgtttacgagtcccgccaccttccgcgcgccgccgtcgatttgcggttggggcggaacatcgtcaaaacagacggcggcttcggcaaaaaaggcgaccggcttaacctcaatatcaccgcacccgatttatcccgtttcggtttcggactcgcggggtctttaaatgtacgcggacacctttccggcgatttggacggcggcatccgaacctttgaaaccgacctttccggcacggcgcgcaacttacacatcggcaaagcggcagacatccgttcgctcgattttaccctcaaaggctcacccggcacaagccgcccgatgcgcgccgatatcaagggcggccgcctttccctgtcgggcggcgcggcggttgtcgataccgccggcctgacgctggaaggtacgggcgcgcagcaccgcatccgcacacacgccgccatgacgctggacggcaaaccgttcaaactcgatttggacgcttcaggcggcatcaacagggaacttacccgatggaaaggcagcatcggcatcctcgacatcggcggcgcattcaacctcaagctgcaaaaccgtatgacgctcgaagccggtgcggaacacgtggcggcaagtgcggcaaattggcaggcaatgggcggcagcctcaacctgcaacacttttcttgggacaggaaaaccggcatatcggcaaaaggcggcgcacgcggcctgcacatcgccgagttgcacaatttcttcaaaccgcccttcgaacacaatctggttttaaacggcgactgggatgtcgcctacgggcacaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcggacggattaacgccgatttgggcatcggcaacgccttcggcggcaatatggcaaatacaccgctcggcggcaggattacagcctcccttcccgacttgggcgcattgaagccctttctgcccgccgccgcgcaaaacattaccggcagcctgaatgcctccgcgcaaatcggcggacgggtaggctctccgtccgtcaatgccgccgtcaacggtagcagcaactacgggaaaatcaacggcaatatcaccgtcgggcaaagccgctccttcgataccgcacctttgggcggcaggctcaacctgaccgttgccgatgccgaagcattccgcaacttcctaccggtcggacaaaccgtcaaaggcagcctgaatgccgccgtaaccctcggcggcagcatcgccgacccgcacttgggcggcagtatcaacggcgacaagctctattaccgcaaccaaacccaaggcatcatcttggacaacggctcgctgcgttcgcatattgcaggcaggaaatgggtaatcgacagcctgaaattccggcacgaagggacggcggaactctccggcacggtcagcatggaaaacagcgtgcccgatgtcgatatcggcgcggtgttcgacaaataccgcatcctgtcccgccccaaccgccgcctgacggtttccggcaacacccgcctgcgctattcgccgcaaaaaggcatatccgttaccggtatgattaaaactgatcaggggctgttcggttcgcaaaaatcctcgatgccgtccgtcggcgacgatgtcgtcgtattgggcgaagtcaagaaagaggcggcggcatcgctccccgtcaatatgaacctgactttagacctcaatgacggcatccgcttctccggctacggcgcggacgttaccataggcggcaaactgaccctgaccgcgcaaccgggcggaaatgtgcgtggggtgggcacggtccgcgtcatcaaagggcgttacaaagcatacgggcaggatttagacattaccaaaggcacagtctcctttgtcggcccgctcaacgaccccaacctgaacatccgcgccgaacgccgcctttcccccgtcggtgcgggcgtggaaatattgggcagcctcaacagcccgcgcattacgctgacggcaaacgaaccgatgagtgaaaaagacaagctctcctggctcatcctcaaccgtgccggcagcggcagcagcggcgacaatgccgccctgtccgcagccgcaggcgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacggcatctccagcgcggaacagtccgtcaaactgatttaccggctgacccgcgccatacaggcggttgcccgtatcggcagccgttcgtcgggcggcgagctgacatacaccatacgtttcgaccgcctcttcggttcggacaaaaaagactccgcaggaaacggcaaagggaaataa

SEQ ID NO: 1188 - protein, 1354 aa, Neisseria gonorrhoeae
LKLSAALLSVLILAVCFLGWIAGTEAGLRFGLYQIPSWFGVNISSQNLKGTLLDGFDGDNWSIETEGADLKISRFRFAWKPSELMRRSLHITDISAGDIAIVTKPTPPKEERPPQGLPDSIDLPAAVYLDRFETGKISMGKTFDKQTVYLERLNAAYRYDRKGHRLDLKAADTPWSSSSGSASVGLKKPFALDTAIYTKGGFEGETIHSTARLSGSLKDVRAELTIDGGNIRLSGKSVIHPFAESLDKTLEEVLVKGFNINPSAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGTGTARTDGSLAIASDPANEQRKLVFDTVNISAGEGSLTAQGYLELFKDRLLKLDIRSRAFDPSRIDPQFPAGDINGSIHLAGELAKEKFTGKMRFLPGTFNGVPIAGSADIVYESRHLPRAAVDLRLGRNIVKTDGGFGKKGDRLNLNITAPDLSRFGFGLAGSLNVRGHLSGDLDGGIRTFETDLSGTARNLHIGKAADIRSLDFTLKGSPGTSRPMRADIKGGRLSLSGGAAVVDTAGLTLEGTGAQHRIRTHAAMTLDGKPFKLDLDASGGINRELTRWKGSIGILDIGGAFNLKLQNRMTLEAGAEHVAASAANWQAMGGSLNLQHFSWDRKTGISAKGGARGLHIAELHNFFKPPFEHNLVLNGDWDVAYGHNARGYLNISRQSGDAVLPGGQALGLNAFSLKTRFQNDRIGILLDGGARFGRINADLGIGNAFGGNMANTPLGGRITASLPDLGALKPFLPAAAQNITGSLNASAQIGGRVGSPSVNAAVNGSSNYGKINGNITVGQSRSFDTAPLGGRLNLTVADAEAFRNFLPVGQTVKGSLNAAVTLGGSIADPHLGGSINGDKLYYRNQTQGIILDNGSLRSHIAGRKWVIDSLKFRHEGTAELSGTVSMENSVPDVDIGAVFDKYRILSRPNRRLTVSGNTRLRYSPQKGISVTGMIKTDQGLFGSQKSSMPSVGDDVVVLGEVKKEAAASLPVNMNLTLDLNDGIRFSGYGADVTIGGKLTLTAQPGGNVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYGISSAEQSVKLIYRLTRAIQAVARIGSRSSGGELTYTIRFDRLFGSDKKDSAGNGKGK

SEQ ID NO: 1189 - DNA, 4065 bp, Neisseria meningitidis
ctgaagctgtcggcggcactgctgtctgtcctgattttggcagtatgtttcctcggctggctcgccggtacggaagcaggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgccttgacctgaaggccgccgacacgccgtggagcagttcgtcgggggcggcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccggccgccttcgtgccttccctgcccgatgccggactgaatttcgacctgaccgccatcccgtcgttttcagacggcatcgcgctggaaggttcgctcgatttggaaaacaccaaagccggctttgccgaccgcaacggcatccccgtccgtcaggttttaggcggctttgtcatccggcaggacggcacggtgcatatcggcaatacgtccgccgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgacccagcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggtgatttggacggcggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggcggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgcaacgcgcgcggctacctcaatatcagccggcaaagcggcgatgccgtattgcccggcgggcaggctttgggtttgaacgcattttccctgaaaacgcgctttcaaaacgaccgcatcggaatcctgcttgacggcggcgcgcgtttcgggcggattaacgccgatttgggcatcgccaacgccttcggcggcaatatggcaaatgcaccgctcggcggcaggattaccgcctcccttcccgacttgggcgcattgaagccctttctgcccgccgccgcgcaaaacattaccggcagcctgaatgccgccgcgcaaatcggcggacgggtaggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtacggggcgtgggcacggtccgcgtcatcaaagggcgttataaggcatacgggcaggatttggacattaccaaaggcacggtctcctttgtcggcccgctcaacgatcccaacctcaacatccgcgccgaacgccgcctttcccccgtcggtgcgggcgtggaaatattgggcagcctcaacagcccgcgcattacgctgacggcaaacgaaccgatgagtgaaaaagacaagctctcttggctcatcctcaaccgcgccggcagcggcagcagcggcgacaatgccgccctgtctgcagccgcaggtgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacggcaaaggaaaataa

SEQ ID NO: 1190 - protein, 1354 aa, Neisseria meningitidis
LKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGAASVGLKKPFALDTAIYTKGGLEGKTIHSTARLSGSLKDVRAELAIDGGNIRLSGKSVIHPFAESLDKTLEEVLVKGFNINPAAFVPSLPDAGLNFDLTAIPSFSDGIALEGSLDLENTKAGFADRNGIPVRQVLGGFVIRQDGTVHIGNTSAALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAAVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLGIANAFGGNMANAPLGGRITASLPDLGALKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNGKGK

SEQ ID NO: 1191 - DNA, 4065 bp, Neisseria meningitidis
ctgaagctgtcggcggcactgctgtctgttctgattttggcagtatgtttcctcggctggctcgccggcacggaagcgggtttgcgcttcgggctgtaccaaatcccgtcttggttcggcgtaaacatttcctcccaaaacctcaaaggcacgctgctcgacggcttcgacggcgacaactggtcgatagaaaccgagggggcagaccttaaaatcagccgcttccgcttcgcgtggaaaccgtccgaactgatgcgccgcagcctgcacattaccgaaatttccgccggcgacatcgccatcgttaccaaaccgactccgcctaaagaagaacgcccgccgctcagccttcccgacagcatagacctgcctgccgccgtctatctcgaccgcttcgagacgggcaaaatcagcatgggcaaagcctttgacaaacaaaccgtctatctcgaacggctggatgcttcataccgttacgaccgcaaaggacaccgcctcgacctgaaggctgccgacacgccgtggagcagttcgtcggggtcagcctcggtcggcttgaaaaaaccgtttgccctcgataccgccatttacaccaaaggcggactcgaaggcaaaaccatacacagtacggctcggctgagcggcagcctgaaggatgtgcgcgccgaactggcgatcgacggcggcaatatccgcctctcgggaaaatccgtcatccacccgtttgccgaatcattggataaaacattggaagaagtactggtcaaagggttcaacatcaatccgtccgccttcgtgccttccctgcccgatgccgggctgaatttcgacctgaccgccatcccgtcgttttcagacggcatcgcgctggaaggctcgctcgatttggaaaacaccaaagccggctttgccgaccgcaacggcatccccgtccgtcaggttttaggcagctttgtcatccggcaggacggcacggtgcatatcggcaatacgtccgtcgccctgctcggacggggcggcatcaggctgtcgggcaaaatcgacaccgaaaaagacatcctcgatttaaatataggcatcaactccgtcggcgcggaagacgtactgcaaaccgcgttcaaaggcaggttggacggcagcatcggcatcggtggcacgaccgcctcgcccaaaatctcttggcaactcggcatcggcacggcgcgcacggacggcagcctcgccattgcaagcgaccccgcaaacggacagcggaaactggtgctcgacaccgtcaacatcgccgccgggcaaggcagcctgaccgcgcaaggctatctcgagctgtttaaagaccgcctgctcaagctggacatccgttcccgcgcattcgacccttcgcgcatcgatccgcaacttccggcaggcaatatcaacggctcaataaaccttgccggcgaactggcaaaagagaaattcacaggcaaaatgcggtttttacccggcacgttcaacggcgtaccgattgccggcagtgccgacattgtttacgagtcccgccaccttccgcgtgccgccgtcgatttgcggctggggcggaacattattaaaacagacggcggcttcggcaaaaaaggcgaccggcttaacctcaatatcaccgcacccgatttatcccgtttcggtttcggactcgcggggtctttaaatgtacgcggacacctttccggcgatttggacggtggcatccgaacctttgaaaccgacctttccggcgcggcgcgcaacctgcacatcggcaaggcggcagacatccgttcgctcgatttcacgctcaaaggttcgcccgacacaagccgcccgatacgcgccgacatcaaaggcagccgcctttcgctgtcgggcggagcggaggttgtcgataccgccgacctgatgctggacggcacgggcgtgcagcaccgcatccgcacacacgccgccatgacgctggatggcaaaccgttcaaattcgatttggacgcttcaggcggcatcaacagggaacttacccgatggaaaggcagcatcggcatcctcgacatcggcggcgcattcaacctcaagctgcaaaaccgtatgacgctcgaagccggtgcggaacgcgtggcggcaagtgcggcaaattggcaggcaatgggcggcagcctcaacctgcaacacttttcttgggataaaaaaaccggcatatcggcaaaaggcggcgcacacggtctgcatatcgccgagttgcacaatttcttcaaaccgcccttcgaacacaatctggttttaaacggcgactgggatgtcgcctacgggcgaaacgcgcgcggctacctcaatatcagccggcaaagcggcgatgccgtattgcccggcgggcaggctttgggtttgaacgcattttccctgaaaacgcgctttcaaaacgaccgtatcggaatcctgcttgacggcggcgcgcgtttcgggcggattaacgccgatttggacatcggcaacgccttcggcggcaatatggcaaatgcaccgctcggcggcaggattaccgcctcccttcccgacttgggcacattgaagccctttctgcccgccgccgcgcaaaacattaccggcagcctgaatgccgccgcgcaaatcggcggacgggtcggctctccgtccgtcaatgccgccgtcaacggcagcagcaactacgggaaaatcaacggcaacatcaccgtcgggcaaagccgctctttcgataccgcgcctttgggcggcaggctcaacctgaccgttgccgatgccgaagtattccgcaacttcctaccggtcggacaaaccgtcaaaggcagcctgaatgccgccgtaaccctcggcggcagcatcgccgatccgcacttgggcggcagcatcaacggcgacaaactctattaccgcaaccaaacccaaggcatcatcttggacaacggctcgctgcgttcgcatatcgcgggcaggaaatgggtaatcgacagcctgaaattccggcacgaagggacggcggaactctccggtacggtcggtatggaaaacagcggacccgatgtcgatatcggcgcggtgttcgacaaataccgcatcctgtcccgccccaaccgccgcctgacggtttccggcaacacccgcctgcgctattcgccgcaaaaaggcatatccgttaccgggatgattaaaacggatcaggggctgttcggttcgcaaaaatcctcgatgccgtccgtcggcgacgatgtcgtcgtattaggcgaagtcaaaaaagaggcggcggcaccgctccccgtcaatatgaacctgactttagacctcaatgacggcatccgcttcgccggctacggcgcggacgttaccataggcggcaaactgaccctgaccgcccaatcgggcggaagcgtgcggggcgtgggcacggtccgcgtcatcaaagggcgttataaggcatacgggcaggatttggacattaccaaaggcacggtctcctttgtcggcccgctcaacgaccccaacctcaacatccgcgccgaacgccgcctttcccccgtcggtgcgggcgtggaaatattgggcagcctcaacagtccgcgcattacgctgacggcaaacgaaccgatgagtgaaaaagacaagctctcctggctcatcctcaaccgcgccggcagtggcagcagcggcgacaatgccgccctgtccgcagccgccggcgcgctgcttgccgggcaaatcaacgaccgcatcgggctggtggatgatttgggctttaccagcaagcgcagccgcaacgcgcaaaccggcgaactcaaccccgccgaacaggtgctgaccgtcggcaaacaactgaccggcaaactctacatcggctacgaatacagcatctccagcgcggaacagtccgtcaaactgatttaccggctgacccgcgccatacaggcggttgcccgtatcggcagccgttcgtcgggcggcgagctgacatacaccatacgtttcgaccgcttctccggttcggacaaaaaagactccgccggaaacagcaaaggaaaataa

SEQ ID NO: 1192 - protein, 1354 aa, Neisseria meningitidis
LKLSAALLSVLILAVCFLGWLAGTEAGLRFGLYQIPSWFGVNISSQNLKGTLLDGFDGDNWSIETEGADLKISRFRFAWKPSELMRRSLHITEISAGDIAIVTKPTPPKEERPPLSLPDSIDLPAAVYLDRFETGKISMGKAFDKQTVYLERLDASYRYDRKGHRLDLKAADTPWSSSSGSASVGLKKPFALDTAIYTKGGLEGKTIHSTARLSGSLKDVRAELAIDGGNIRLSGKSVIHPFAESLDKTLEEVLVKGFNINPSAFVPSLPDAGLNFDLTAIPSFSDGIALEGSLDLENTKAGFADRNGIPVRQVLGSFVIRQDGTVHIGNTSVALLGRGGIRLSGKIDTEKDILDLNIGINSVGAEDVLQTAFKGRLDGSIGIGGTTASPKISWQLGIGTARTDGSLAIASDPANGQRKLVLDTVNIAAGQGSLTAQGYLELFKDRLLKLDIRSRAFDPSRIDPQLPAGNINGSINLAGELAKEKFTGKMRFLPGTFNGVPIAGSADIVYESRHLPRAAVDLRLGRNIIKTDGGFGKKGDRLNLNITAPDLSRFGFGLAGSLNVRGHLSGDLDGGIRTFETDLSGAARNLHIGKAADIRSLDFTLKGSPDTSRPIRADIKGSRLSLSGGAEVVDTADLMLDGTGVQHRIRTHAAMTLDGKPFKFDLDASGGINRELTRWKGSIGILDIGGAFNLKLQNRMTLEAGAERVAASAANWQAMGGSLNLQHFSWDKKTGISAKGGAHGLHIAELHNFFKPPFEHNLVLNGDWDVAYGRNARGYLNISRQSGDAVLPGGQALGLNAFSLKTRFQNDRIGILLDGGARFGRINADLDIGNAFGGNMANAPLGGRITASLPDLGTLKPFLPAAAQNITGSLNAAAQIGGRVGSPSVNAAVNGSSNYGKINGNITVGQSRSFDTAPLGGRLNLTVADAEVFRNFLPVGQTVKGSLNAAVTLGGSIADPHLGGSINGDKLYYRNQTQGIILDNGSLRSHIAGRKWVIDSLKFRHEGTAELSGTVGMENSGPDVDIGAVFDKYRILSRPNRRLTVSGNTRLRYSPQKGISVTGMIKTDQGLFGSQKSSMPSVGDDVVVLGEVKKEAAAPLPVNMNLTLDLNDGIRFAGYGADVTIGGKLTLTAQSGGSVRGVGTVRVIKGRYKAYGQDLDITKGTVSFVGPLNDPNLNIRAERRLSPVGAGVEILGSLNSPRITLTANEPMSEKDKLSWLILNRAGSGSSGDNAALSAAAGALLAGQINDRIGLVDDLGFTSKRSRNAQTGELNPAEQVLTVGKQLTGKLYIGYEYSISSAEQSVKLIYRLTRAIQAVARIGSRSSGGELTYTIRFDRFSGSDKKDSAGNSKGK

SEQ ID NO: 1193 - DNA, 1569 bp, Neisseria gonorrhoeae
atgcagaacaccggtaccatgatgatcaaaccgaccgccctgctcctgccggctttatttttctttccgcacgcatacgcgcctgccgccgacctttccgaaaacaaggcggcgggtttcgcattgttcaaaagcaaaagccccgacaccgaatcagtcaaattaaaacccaaattccccgtccgcatcgacacgcaggacagtgaaatcaaagatatggtcgaagaacacctgccgctcatcacgcagcagcaggaagaggttttggataaggaacagacgggattccttgccgaagaagcaccggacaacgttaaaacaatgctccgcagcaaaggctatttcagcagcaaggtcagcctgacggaaaaagacggagcttatacggtgcacatcacaccgggcccgcgcaccaaaatcgccaacgtcggcgtcgccatcctcggcgacatcctttcagacggcaacctcgccgaatactaccgcaacgcgctggaaaactggcagcagccggtaggcagcgatttcgatcaggacagttgggaaaacagcaaaacttccgtcctcggcgcggtaacgcgcaaaggctacccgcttgccaagctcggcaacacccgggcggccgtcaaccccgataccgccaccgccgatttgaacgtcgtcgtggacagcggccgccccattgccttcggcgactttgaaatcaccggcacacagcgttaccccgaacaaaccgtctccggcctggcgcgcttccaaccgggcacgccctacgacctcgacctgctgctcgacttccaacaggcgctcgaacaaaacgggcattattccggcgcgtccgtacaagccgacttcgaccgcctcccaaggggaccgcgtccccgtcaaagtcagcgtaaccgaggtcaaacgccacaaactcgaaaccggcatccgcctcgattcggaatacggtttgggcggcaaaatcgcctacgactattacaacctcttcaacaaaggctatatcggctcggtcgtctgggatatggacaaatacgaaaccacgcttgccgccggcatcagccagccgcgcaactatcggggcaactactggacaagcaacgtttcctacaaccgttcgaccacccaaaacctcgaaaaacgcgccttctccggcggcatctggtatgtgcgcgaccgcgcgggcatcgatgccaggctgggggcggaatttctcgcagaaggccggaaaatccccggctcggatgtcgatttgggcaacagccacgccacgatgctgaccgcctcttggaaacgccagctgctcaacaacgtgctgcaccccgaaaacggccattacctcgacggcaaaatcgggacgactttgggcacattcctgtcctccaccgcgctaatccgcacctctgcccgcgcaggttatttcttcacgcccgaaaacaaaaaactcggcacgttcatcatacgcggacaagcgggttacaccgttgcacgcgacaatgccgatgtcccctcggggctgatgttccgcagcggcggcgcgtcttccgtgcgcggttacgaacttga

SEQ ID NO: 1194 - protein, 522 aa, Neisseria gonorrhoeae
MQNTGTMMIKPTALLLPALFFFPHAYAPAADLSENKAAGFALFKSKSPDTESVKLKPKFPVRIDTQDSEIKDMVEEHLPLITQQQEEVLDKEQTGFLAEEAPDNVKTMLRSKGYFSSKVSLTEKDGAYTVHITPGPRTKIANVGVAILGDILSDGNLAEYYRNALENWQQPVGSDFDQDSWENSKTSVLGAVTRKGYPLAKLGNTRAAVNPDTATADLNVVVDSGRPIAFGDFEITGTQRYPEQTVSGLARFQPGTPYDLDLLLDFQQALEQNGHYSGASVQADFDRLPRGPRPRQSQRNRGQTPQTRNRHPPRFGIRFGRQNRLRLLQPLQQRLYRLGRLGYGQIRNHACRRHQPAAQLSGQLLDKQRFLQPFDHPKPRKTRLLRRHLVCARPRGHRCQAGGGISRRRPENPRLGCRFGQQPRHDADRLLETPAAQQRAAPRKRPLPRRQNRDDFGHIPVLHRANPHLCPRRLFLHARKQKTRHVHHTRTSGLHRCTRQCRCPLGADVPQRRRVFRARLRT

SEQ ID NO: 1195 - DNA, 1848 bp, Neisseria meningitidis
atgcacgacacccgtaccatgatgatcaaaccgaccgccctgctcctgccggctttatttttctttccgcacgcatacgcgcctgccgccgacctttccgaaaacaaggcggcgggtttcgcattgttcaaaaacaaaagccccgacaccgaatcagtcaaattaaaacccaaattccccgtcctcatcgacacgcaggacagtgaaatcaaagatatggtcgaagaacacctgccgctcatcacgcagcagcaggaagaagtattggacaaggaacagacgggcttcctcgccgaagaagcgccggacaacgttaaaacgatgctccgcagcaaaggctatttcagcagcaaagtcagcctgacggaaaaagacggagcttatacggtacacatcacaccgggcccgcgcaccaaaatcgccaacgtcggcgtcgccatcctcggcgacatcctttcagacggcaacctcgccgaatactaccgcaacgcgctggaaaactggcagcagccggtaggcagcgatttcgatcaggacagttgggaaaacagcaaaacttccgtcctcggcgcggtaacgcgcaaagcctacccgcttgccaagctcggcaatacgcaggcggccgtcaaccccgataccgccaccgccgatttgaacgtcgtcgtggacagcggccgccccatcgccttcggcgactttgaaatcaccggcacacagcgttaccccgaacaaatcgtctccggccttgcgcgtttccagcccggtatgccgtacgacctcgacctgctgctcgacttccaacaggcgctcgaacaaaacgggcattattccggcgcgtccgtacaagccgacttcgaccgcctccaaggcgaccgcgtccccgtcaaagtcagcgtaaccgaggtcaaacgccacaaactcgaaaccggcatccgcctcgattcggaatacggtttgggcggcaaaatcgcctacgactattacaacctcttcaacaaaggctatatcggttcggtcgtctgggatatggacaaatacgaaaccacgcttgccgccggcatcagccagccgcgcaactatcggggcaactactggacaagcaacgtttcctacaaccgttcgaccacccaaaacctcgaaaaacgcgccttctccggcggcgtctggtatgtgcgcgaccgcgcgggcatcgatgccaggctgggggcggaatttctcgcagaaggccggaaaatccccggctcggctgtcgatttgggcaacagccacgccacgatgctgaccgcctcttggaaacgccagctgctcaacaacgtgctgcatcccgaaaacggccattacctcgacggcaaaatcggtacgactttgggcacattcctgtcctccaccgcgctgatccgcacctctgcccgtgcaggttatttcttcacgcccgaaaacaaaaaactcggcacgttcatcatacgcggacaagcgggttacaccgttgcccgcgacaatgccgacgttccttcagggctgatgttccgcagcggcggcgcgtcttccgtgcgcggttacgaactcgacagcatcggacttgccggcccgaacggatcggtcctgcccgaacgcgccctcctggtgggcagcctggaataccaactgccgtttacgcgcaccctttccggcgcggtgttccacgatatgggcgatgccgccgccaatttcaaacgtatgaagctgaaacacggttcgggactgggcgtgcgctggttcagcccgcttgcgccgttttccttcgacatcgcctacgggcacagcgataagaaaatccgctggcacatcagcttgggaacgcgcttctaa

SEQ ID NO: 1196 - protein, 615 aa, Neisseria meningitidis
MHDTRTMMIKPTALLLPALFFFPHAYAPAADLSENKAAGFALFKNKSPDTESVKLKPKFPVLIDTQDSEIKDMVEEHLPLITQQQEEVLDKEQTGFLAEEAPDNVKTMLRSKGYFSSKVSLTEKDGAYTVHITPGPRTKIANVGVAILGDILSDGNLAEYYRNALENWQQPVGSDFDQDSWENSKTSVLGAVTRKAYPLAKLGNTQAAVNPDTATADLNVVVDSGRPIAFGDFEITGTQRYPEQIVSGLARFQPGMPYDLDLLLDFQQALEQNGHYSGASVQADFDRLQGDRVPVKVSVTEVKRHKLETGIRLDSEYGLGGKIAYDYYNLFNKGYIGSVVWDMDKYETTLAAGISQPRNYRGNYWTSNVSYNRSTTQNLEKRAFSGGVWYVRDRAGIDARLGAEFLAEGRKIPGSAVDLGNSHATMLTASWKRQLLNNVLHPENGHYLDGKIGTTLGTFLSSTALIRTSARAGYFFTPENKKLGTFIIRGQAGYTVARDNADVPSGLMFRSGGASSVRGYELDSIGLAGPNGSVLPERALLVGSLEYQLPFTRTLSGAVFHDMGDAAANFKRMKLKHGSGLGVRWFSPLAPFSFDIAYGHSDKKIRWHISLGTRF

SEQ ID NO: 1197 - DNA, 1848 bp, Neisseria meningitidis
atgcacgacacccgtaccatgatgattaaaccgaccgccctgctcctgccggctttatttttctttccgcacgcatacgcgcctgccgccgacctttccgaaaacaaggcggcgggtttcgcattgttcaaaaacaaaagccccgacaccgaatcagttaaattaaaacccaaattccccgtccgcatcgacacgcaggatagtgaaatcaaagatatggtcgaagaacacctgccgctcatcacgcagcagcaggaagaagtattggacaaggaacagacgggcttcctcgccgaagaagcaccggacaacgttaaaacaatgctccgcagcaaaggctatttcagcagcaaagtcagcctgacggaaaaagacggagcttatacggtacacatcacaccgggcccgcgcaccaaaatcgccaacgtcggcgtcgccatcctcggcgacatcctttcagacggcaacctcgccgaatactaccgcaacgcgctggaaaactggcagcagccggtaggcagtgatttcgatcaggacagttgggaaaacagcaaaacttccgtcctcggcgcggtaacgcgcaaagcctacccgcttgccaagctcggcaacacccgggcggccgtcaaccccgataccgccaccgccgatttgaacgtcgtcgtggacagcggccgccccatcgccttcggcgactttgaaattaccggcacgcagcgttaccccgaacaaatcgtctccggcttggcgcgcttccaaccgggcacgccctacgacctcgacctgctgctcgacttccaacaggcgctcgaacaaaacgggcattattccggcgcgtccgtacaagccgacttcgaccgcctccaaggcgaccgcgtccccgtcaaagtcagcgtaaccgaggtcaaacgccacaagctcgaaaccggcatccgcctcgattcggaatacggtttgggcggcaaaatcgcctacgactattacaacctcttcaacaaaggctatatcggttcggtcgtctgggatatggacaaatacgaaaccacgcttgccgccggcatcagccagccgcgcaactatcggggcaactactggacaagcaacgtttcctacaaccgttcgaccacccaaaacctcgaaaaacgcgccttctccggcggcatctggtatgtgcgcgaccgcgcgggcatcgatgccaggctgggggcggagtttctcgcagaaggccggaaaatccccggctcggatatcgatttgggcaacagccacgccacgatgctgaccgcctcttggaaacgccagctgctcaacaacgtgctgcatcccgaaaacggccattacctcgacggcaaaatcggtacgactttgggcgcattcctgtcctccaccgcgctgatccgcacctctgcccgcgcaggttatttcttcacgcccgaaaacaaaaaactcggcacgttcatcatacgcggacaagcgggttacaccgttgcccgcgacaatgccaacgttccttcagggctgatgttccgcagcggcggcgcgtcttccgtgcgcggttacgaactcgacagcatcgggcttgccggcccgaacggatcggtcctgcccgaacgcgccctcttggtgggcagcctggaataccaactgccgtttacgcgcaccctttccggcgcggtgttccacgatatgggcgacgccgccgccaatttcaaacgtatgaagctgaaacacggttcgggactgggcgtgcgctggttcagcccgctcgcgccgttttccttcgacatcgcctacgggcacagcgacaagaaaatccgctggcacatcagcttgggaacgcgcttctaa

SEQ ID NO: 1198 - protein, 615 aa, Neisseria meningitidis
MHDTRTMMIKPTALLLPALFFFPHAYAPAADLSENKAAGFALFKNKSPDTESVKLKPKFPVRIDTQDSEIKDMVEEHLPLITQQQEEVLDKEQTGFLAEEAPDNVKTMLRSKGYFSSKVSLTEKDGAYTVHITPGPRTKIANVGVAILGDILSDGNLAEYYRNALENWQQPVGSDFDQDSWENSKTSVLGAVTRKAYPLAKLGNTRAAVNPDTATADLNVVVDSGRPIAFGDFEITGTQRYPEQIVSGLARFQPGTPYDLDLLLDFQQALEQNGHYSGASVQADFDRLQGDRVPVKVSVTEVKRHKLETGIRLDSEYGLGGKIAYDYYNLFNKGYIGSVVWDMDKYETTLAAGISQPRNYRGNYWTSNVSYNRSTTQNLEKRAFSGGIWYVRDRAGIDARLGAEFLAEGRKIPGSDIDLGNSHATMLTASWKRQLLNNVLHPENGHYLDGKIGTTLGAFLSSTALIRTSARAGYFFTPENKKLGTFIIRGQAGYTVARDNANVPSGLMFRSGGASSVRGYELDSIGLAGPNGSVLPERALLVGSLEYQLPFTRTLSGAVFHDMGDAAANFKRMKLKHGSGLGVRWFSPLAPFSFDIAYGHSDKKIRWHISLGTRF

SEQ ID NO: 1199 - DNA, 1290 bp, Neisseria gonorrhoeae
atgtttaaacgcagtgtgattgcaatggcttgtatttttcccctttcagcctgtgggggcggcggtggcggatcgcccgatgtcaagtcggcggacacgccgtcaaaaccggccgcccccgttgttgctgaaaatgccggggaaggggtgctgccgaaagaaaagaaagatgaggaggcagcgggcggtgcgccgcaagccgatacgcaggacgcaaccgccggagaaggcagccaagatatggcggcagtttcggcagaaaatacaggcaatggcggtgcggcaacaacggacaaccccaaaaatgaagacgcgggggcgcaaaatgatatgccgcaaaatgccgccgaatccgcaaatcaaacagggaacaaccaacccgccggttcttcagattccgcccccgcgtcaaaccctgcccctgcgaatggcggtagcgattttggaaggacgaacgtgggcaattctgttgtgattgacggaccgtcgcaaaatataacgttgacccactgtaaaggcgattcttgtaatggtgataatttattggatgaagaagcaccgtcaaaatcagaatttgaaaaattaagtgatgaagaaaaaattaagcgatataaaaaagacgagcaacgggagaattttgtcggtttggttgctgacagggtaaaaaaggatggaactaacaaatatatcatcttctatacggacaaaccacctactcgttctgcacggtcgaggaggtcgcttccggccgagattccgctgattcccgtcaatcaggccgatacgctgattgtggatggggaagcggtcagcctgacggggcattccggcaatatcttcgcgcccgaagggaattaccggtatctgacttacggggcggaaaaattgcccggcggatcgtatgccctccgtgtgcaaggcgaaccggcaaaaggcgaaatgcttgttggcacggccgtgtacaacggcgaagtgctgcatttccatatggaaaacggccgtccgtacccgtccggaggcaggtttgccgcaaaagtcgatttcggcagcaaatctgtggacggcattatcgacagcggcgatgatttgcatatgggtacgcaaaaattcaaagccgccatcgatggaaacggctttaaggggacttggacggaaaatggcggcggggatgtttccggaaggttttacggcccggccggcgaggaagtggcgggaaaatacagctatcgcccgacagatgctgaaaagggcggattcggcgtgtttgccggcaaaaaagatcgggattga

SEQ ID NO: 1200 - protein, 429 aa, Neisseria gonorrhoeae
MFKRSVIAMACIFPLSACGGGGGGSPDVKSADTPSKPAAPVVAENAGEGVLPKEKKDEEAAGGAPQADTQDATAGEGSQDMAAVSAENTGNGGAATTDNPKNEDAGAQNDMPQNAAESANQTGNNQPAGSSDSAPASNPAPANGGSDFGRTNVGNSVVIDGPSQNITLTHCKGDSCNGDNLLDEEAPSKSEFEKLSDEEKIKRYKKDEQRENFVGLVADRVKKDGTNKYIIFYTDKPPTRSARSRRSLPAEIPLIPVNQADTLIVDGEAVSLTGHSGNIFAPEGNYRYLTYGAEKLPGGSYALRVQGEPAKGEMLVGTAVYNGEVLHFHMENGRPYPSGGRFAAKVDFGSKSVDGIIDSGDDLHMGTQKFKAAIDGNGFKGTWTENGGGDVSGRFYGPAGEEVAGKYSYRPTDAEKGGFGVFAGKKDRD

SEQ ID NO: 1201 - DNA, 1467 bp, Neisseria meningitidis
atgtttaaacgcagcgtaatcgcaatggcttgtatttttgccctttcagcctgcgggggcggcggtggcggatcgcccgatgtcaagtcggcggacacgctgtcaaaacctgccgcccctgttgtttctgaaaaagagacagaggcaaaggaagatgcgccacaggcaggttctcaaggacagggcgcgccatccgcacaaggcagtcaagatatggcggcggtttcggaagaaaatacaggcaatggcggtgcggtaacagcggataatcccaaaaatgaagacgaggtggcacaaaatgatatgccgcaaaatgccgccggtacagatagttcgacaccgaatcacaccccggatccgaatatgcttgccggaaatatggaaaatcaagcaacggatgccggggaatcgtctcagccggcaaaccaaccggatatggcaaatgcggcggacggaatgcagggggacgatccgtcggcaggcgggcaaaatgccggcaatacggctgcccaaggtgcaaatcaagccggaaacaatcaagccgccggttcttcagatcccatccccgcgtcaaaccctgcacctgcgaatggcggtagcaattttggaagggttgatttggctaatggcgttttgattgacgggccgtcgcaaaatataacgttgacccactgtaaaggcgattcttgtagtggcaataatttcttggatgaagaagtacagctaaaatcagaatttgaaaaattaagtgatgcagacaaaataagtaattacaagaaagatgggaagaatgataaatttgtcggtttggttgccgatagtgtgcagatgaagggaatcaatcaatatattatcttttataaacctaaacccacttcatttgcgcgatttaggcgttctgcacggtcgaggcggtcgcttccggccgagatgccgctgattcccgtcaatcaggcggatacgctgattgtcgatggggaagcggtcagcctgacggggcattccggcaatatcttcgcgcccgaagggaattaccggtatctgacttacggggcggaaaaattgcccggcggatcgtatgcccttcgtgttcaaggcgaaccggcaaaaggcgaaatgcttgcgggcgcggccgtgtacaacggcgaagtactgcatttccatacggaaaacggccgtccgtacccgaccaggggcaggtttgccgcaaaagtcgatttcggcagcaaatctgtggacggcattatcgacagcggcgatgatttgcatatgggtacgcaaaaattcaaagccgccatcgatggaaacggctttaaggggacttggacggaaaatggcagcggggatgtttccggaaagttttacggcccggccggcgaggaagtggcgggaaaatacagctatcgcccgacagatgcggaaaagggcggattcggcgtgtttgccggcaaaaaagagcaggattga

SEQ ID NO: 1202 - protein, 488 aa, Neisseria meningitidis
MFKRSVIAMACIFALSACGGGGGGSPDVKSADTLSKPAAPVVSEKETEAKEDAPQAGSQGQGAPSAQGSQDMAAVSEENTGNGGAVTADNPKNEDEVAQNDMPQNAAGTDSSTPNHTPDPNMLAGNMENQATDAGESSQPANQPDMANAADGMQGDDPSAGGQNAGNTAAQGANQAGNNQAAGSSDPIPASNPAPANGGSNFGRVDLANGVLIDGPSQNITLTHCKGDSCSGNNFLDEEVQLKSEFEKLSDADKISNYKKDGKNDKFVGLVADSVQMKGINQYIIFYKPKPTSFARFRRSARSRRSLPAEMPLIPVNQADTLIVDGEAVSLTGHSGNIFAPEGNYRYLTYGAEKLPGGSYALRVQGEPAKGEMLAGAAVYNGEVLHFHTENGRPYPTRGRFAAKVDFGSKSVDGIIDSGDDLHMGTQKFKAAIDGNGFKGTWTENGSGDVSGKFYGPAGEEVAGKYSYRPTDAEKGGFGVFAGKKEQD

SEQ ID NO: 1203 - DNA, 1494 bp, Neisseria meningitidis
atgtttaaacgcagtgtgattgcaatggcttgtattgttgccctttcagcctgtgggggcggcggtggcggatcgcccgatgttaagtcggcggacacgctgtcaaaacctgccgcccctgttgttactgaagatgtcggggaagaggtgctgccgaaagaaaagaaagatgaggaggcggtgagtggtgcgccgcaagccgatacgcaggacgcaaccgccggaaaaggcggtcaagatatggcggcagtttcggcagaaaatacaggcaatggcggtgcggcaacaacggataatcccgaaaataaagacgagggaccgcaaaatgatatgccgcaaaatgccgccgatacagatagttcgacaccgaatcacacccctgcaccgaatatgccaaccagagatatgggaaaccaagcaccggatgccggggaatcggcacaaccggcaaaccaaccggatatggcaaatgcggcggacggaatgcagggggacgatccgtcggcaggggaaaatgccggcaatacggcagatcaagctgcaaatcaagctgaaaacaatcaagtcggcggctctcaaaatcctgcctcttcaaccaatcctaacgccacgaatggcggcagcgattttggaaggataaatgtagctaatggcatcaagcttgacagcggttcggaaaatgtaacgttgacacattgtaaagacaaagtatgcgatagagatttcttagatgaagaagcaccaccaaaatcagaatttgaaaaattaagtgatgaagaaaaaattaataaatataaaaaagacgagcaacgagagaattttgtcggtttggttgctgacagggtagaaaagaatggaactaacaaatatgtcatcatttataaagacaagtccgcttcatcttcatctgcgcgattcaggcgttctgcacggtcgaggcggtcgcttccggccgagatgccgctgattcccgtcaatcaggcggatacgctgattgtcgatggggaagcggtcagcctgacggggcattccggcaatatcttcgcgcccgaagggaattaccggtatctgacttacggggcggaaaaattgtccggcggatcgtatgccctcagtgtgcaaggcgaaccggcaaaaggcgaaatgcttgcgggcacggccgtgtacaacggcgaagtgctgcatttccatatggaaaacggccgtccgtccccgtccggaggcaggtttgccgcaaaagtcgatttcggcagcaaatctgtggacggcattatcgacagcggcgatgatttgcatatgggtacgcaaaaattcaaagccgttatcgatggaaacggctttaaggggacttggacggaaaatggcggcggggatgtttccggaaggttttacggcccggccggcgaagaagtggcgggaaaatacagctatcgcccgacagatgcggaaaagggcggattcggcgtgtttgccggcaaaaaagagcaggattga

SEQ ID NO: 1204 - protein, 497 aa, Neisseria meningitidis
MFKRSVIAMACIVALSACGGGGGGSPDVKSADTLSKPAAPVVTEDVGEEVLPKEKKDEEAVSGAPQADTQDATAGKGGQDMAAVSAENTGNGGAATTDNPENKDEGPQNDMPQNAADTDSSTPNHTPAPNMPTRDMGNQAPDAGESAQPANQPDMANAADGMQGDDPSAGENAGNTADQAANQAENNQVGGSQNPASSTNPNATNGGSDFGRINVANGIKLDSGSENVTLTHCKDKVCDRDFLDEEAPPKSEFEKLSDEEKINKYKKDEQRENFVGLVADRVEKNGTNKYVIIYKDKSASSSSARFRRSARSRRSLPAEMPLIPVNQADTLIVDGEAVSLTGHSGNIFAPEGNYRYLTYGAEKLSGGSYALSVQGEPAKGEMLAGTAVYNGEVLHFHMENGRPSPSGGRFAAKVDFGSKSVDGIIDSGDDLHMGTQKFKAVIDGNGFKGTWTENGGGDVSGRFYGPAGEEVAGKYSYRPTDAEKGGFGVFAGKKEQD

SEQ ID NO: 1205 - DNA, 549 bp, Neisseria gonorrhoeae
atgcacaccggacaggcggtaagccgggttctgtctcggacagtcattcctctaggcataccgttgccggtatgctcaagcaacctacccgaacgctcggcgggcagcgtcattgcgttctgtttggtcttgctccgaatggggtttggcctgccgcatattgttaccaaatgcgcggtgcgcccttaccgcaccttttcacccttgcctgtgctgccaaagcagccatcggcggttttgctttctgttccactttccgtcgcgttaccgcgcccggccgttaaccggcattctaccctgcggagcccggactttcctccccgtatgccttacgcgatacgcggcgactgtctgcccgtcccgtgtgcggcgcggattataacacgaaacgcaaaaatgccgtctgaaacggtacaggtttcagacggcatacagcctaaactacacaccctgtttcaggctggcttcgatgaagccgtccaagtcgccgtccaatacggctttgtggttgccgacttcgtagcctgtacgcaagtctttgatgcgtga

SEQ ID NO: 1206 - protein, 182 aa, Neisseria gonorrhoeae
MHTGQAVSRVLSRTVIPLGIPLPVCSSNLPERSAGSVIAFCLVLLRMGFGLPHIVTKCAVRPYRTFSPLPVLPKQPSAVLLSVPLSVALPRPAVNRHSTLRSPDFPPRMPYAIRGDCLPVPCAARIITRNAKMPSETVQVSDGIQPKLHTLFQAGFDEAVQVAVQYGFVVADFVACTQVFDA

SEQ ID NO: 1207 - DNA, 549 bp, Neisseria meningitidis
atgcacaccggacaggcggtaagccgggttctgtctcggacagtcattcctctaggcataccgttaccggtatgctcaagcaacctacccgaacgctcggcgggcagcgtcattgcgttctgtttggtcttgctccgaatggggtttggcctgccgcatattgttaccaaatgcgcggtgcgcccttaccgcaccttttcacccttacctgtgctgccaaagcagccatcggcggttttgctttctgttccactttccgtcgcgttaccgcgcccggccgttaaccggcattctaccctgcggagcccggactttcctccccgtatgccttacgcgatacgcggcgactgtctgcccgtcccgtgtgcggcgcggattataacacgaaacacaaaaatgccgtctgaaacggtacaggtttcagacggcatacagcctaaactacacgccctgtttcaggctggcttcgatgaagccgtccaagtcgccatccaatacggctttggtgttgccgacttcgtagcctgtacgcaagtctttgatacgtga

SEQ ID NO: 1208 - protein, 182 aa, Neisseria meningitidis
MHTGQAVSRVLSRTVIPLGIPLPVCSSNLPERSAGSVIAFCLVLLRMGFGLPHIVTKCAVRPYRTFSPLPVLPKQPSAVLLSVPLSVALPRPAVNRHSTLRSPDFPPRMPYAIRGDCLPVPCAARIITRNTKMPSETVQVSDGIQPKLHALFQAGFDEAVQVAIQYGFGVADFVACTQVFDT

SEQ ID NO: 1209 - DNA, 549 bp, Neisseria meningitidis
atgcacaccggacaggcggtaagccgggttctgtctcggacagtcattcctctaggcataccgttgccggtatgctcaagcaacctacccgaacgctcggcgggcagcgtcattgcgttctgtttggtcttgctccgaatggggtttggcctgccgcatattgttaccaaatgcgcggtgcgcccttaccgcaccttttcacccttgcctgtgctgccaaagcagccatcggcggttttgctttctgttccactttccgtcgcgttaccgcgcccggccgttaaccggcattctaccctgcggagcccggactttcctccccgtatgccttacgcgatacgcggcgactgtctgcccgtcccgtgtgcggcgcggattataacacgaaacgcaaaaatgccgtctgaaacggtacaggtttcagacggcatacagcctaaactacacgccctgtttcaggctggcttcgataaagccgtccaagtcgccgtccaatacggctttggtgttgccgacttcgtagcctgtgcgcaagtctttaatgcgtga

SEQ ID NO: 1210 - protein, 182 aa, Neisseria meningitidis
MHTGQAVSRVLSRTVIPLGIPLPVCSSNLPERSAGSVIAFCLVLLRMGFGLPHIVTKCAVRPYRTFSPLPVLPKQPSAVLLSVPLSVALPRPAVNRHSTLRSPDFPPRMPYAIRGDCLPVPCAARIITRNAKMPSETVQVSDGIQPKLHALFQAGFDKAVQVAVQYGFGVADFVACAQVFNA

SEQ ID NO: 1211 - DNA, 1179 bp, Neisseria gonorrhoeae
atggcaaaaatgatgaaatgggcggctgttgcggcggtcgcggcggcagcggtttggggcggatggtcttatctgaagcccgaaccgcaggctgcttatattacggaagcggtcaggcgcggcgatatcagccggacggtttccgcgacgggcgagatttcgccgtccaacctggtatcggtcggcgcgcaggcttcggggcagattaaaaagctttatgtcaaactcgggcaacaggtcaaaaagggcgatttgattgcggaaatcaattcgaccacgcagaccaacacgatcgatatggaaaaatccaaattggaaacgtatcaggcgaagctggtgtccgcacagattgcattgggcagcgcggaaaaaaaatataagcgtcaggcggcgttgtggaaggatgatgcgacctctaaagaagatttggaaagcgcgcaggatgcgcttgccgccgccaaagccaatgttgccgagttgaaggctttaatcagacagagcaaaatttccatcaataccgccgagtcggatttgggctacacgcgcattaccgcgacgatggacggcacggtggtggcgattcccgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggctacaacagcagtacggatacggcttccaatgcggtctattattatgcccgttcgtttgtgccgaatccggacggcaaactcgccacggggatgacgacgcagaatacggttgaaatcgacggtgtgaaaaatgtgttgcttattccgtcgctgaccgtgaaaaatcgcggcggcaaggcgttcgtacgcgtgttgggtgcggacggcaaggcagtggaacgcgaaatccggaccggtatgaaagacagtatgaataccgaagtgaaaagcgggttgaaagagggggacaaagtggtcatctccgaaataaccgccgccgagcagcaggaaagcggcgaacgcgccctaggcggcccgccgcgccgataa

SEQ ID NO: 1212 - protein, 392 aa, Neisseria gonorrhoeae
MAKMMKWAAVAAVAAAAVWGGWSYLKPEPQAAYITEAVRRGDISRTVSATGEISPSNLVSVGAQASGQIKKLYVKLGQQVKKGDLIAEINSTTQTNTIDMEKSKLETYQAKLVSAQIALGSAEKKYKRQAALWKDDATSKEDLESAQDALAAAKANVAELKALIRQSKISINTAESDLGYTRITATMDGTVVAIPVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLLIPSLTVKNRGGKAFVRVLGADGKAVEREIRTGMKDSMNTEVKSGLKEGDKVVISEITAAEQQESGERALGGPPRR

SEQ ID NO: 1213 - DNA, 1005 bp, Neisseria meningitidis
gtatcggtcggcgcgcaggcatcggggcagattaagatactttatgtcaaactcgggcaacaggttaaaaagggcgatttgattgcggaaatcaattcgacctcgcagaccaatacgctcaatacggaaaaatccaagttggaaacgtatcaggcgaagctggtgtcggcacagattgcattgggcagcgcggagaagaaatataagcgtcaggcggcgttatggaaggaaaacgcgacttccaaagaggatttggaaagcgcgcaggatgcgtttgccgccgccaaagccaatgttgccgagctgaaggctttaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggttacaacagcagtacggatacggcttccaatgcggtctactattatgcccgttcgtttgtgccgaatccggacggcaaactcgccacggggatgacgacgcagaatacggttgaaatcgacggcgtgaaaaatgtgctgattattccgtcgctgaccgtgaaaaatcgcggcggcaaggcgtttgtgcgcgtgttgggtgcggacggcaaggcggcggaacgcgaaatccggaccggtatgagagacagtatgaataccgaagtaaaaagcgggttgaaagagggggacaaagtggtcatctccgaaataaccgccgccgagcaacaggaaagcggcgaacgcgccctaggcggcccgccgcgccgataa

SEQ ID NO: 1214 - protein, 334 aa, Neisseria meningitidis
VSVGAQASGQIKILYVKLGQQVKKGDLIAEINSTSQTNTLNTEKSKLETYQAKLVSAQIALGSAEKKYKRQAALWKENATSKEDLESAQDAFAAAKANVAELKALIRQSKISINTAESELGYTRITATMDGTVVAILVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLIIPSLTVKNRGGKAFVRVLGADGKAAEREIRTGMRDSMNTEVKSGLKEGDKVVISEITAAEQQESGERALGGPPRR

SEQ ID NO: 1215 - DNA, 1179 bp, Neisseria meningitidis
atggcaaaaatgatgaaatgggcggctgttgcggcggtcgcggcggcagcggtttggggcggatggtcttatctgaagcccgagccgcaggctgcttatattacggaaacggtcaggcgcggcgacatcagccggacggtttctgcaacaggggagatttcgccgtccaacctggtatcggtcggcgcgcaggcatcggggcagattaagaaactttatgtcaaactcgggcaacaggttaaaaagggcgatttgattgcggaaatcaattcgacctcgcagaccaatacgctcaatacggaaaaatccaaattggaaacgtatcaggcgaagctggtgtcggcacagattgcattgggcagcgcggagaagaaatataagcgtcaggcggcgttgtggaaggatgatgcgaccgctaaagaagatttggaaagcgcacaggatgcgcttgccgccgccaaagccaatgttgccgagctgaaggctctaatcagacagagcaaaatttccatcaataccgccgagtcggaattgggctacacgcgcattaccgcaacgatggacggcacggtggtggcgattctcgtggaagaggggcagactgtgaacgcggcgcagtctacgccgacgattgtccaattggcgaatctggatatgatgttgaacaaaatgcagattgccgagggcgatattaccaaggtgaaggcggggcaggatatttcgtttacgattttgtccgaaccggatacgccgattaaggcgaagctcgacagcgtcgaccccgggctgaccacgatgtcgtcgggcggctacaacagcagtacggatacggcttccaatgcggtctactattatgcccgttcgtttgtgccgaatccggacggcaaactcgccacggggatgacgacgcagaatacggttgaaatcgacggtgtgaaaaatgtgctgattattccgtcgctgaccgtgaaaaatcgcggcggcagggcgtttgtgcgcgtgttgggtgcagacggcaaggcggcggaacgcgaaatccggaccggtatgagagacagtatgaataccgaagtaaaaagcgggttgaaagagggggacaaagtggtcatctccgaaataaccgccgccgagcagcaggaaagcggcgaacgcgccctaggcggcccgccgcgccgataa

SEQ ID NO: 1216 - protein, 392 aa, Neisseria meningitidis
MAKMMKWAAVAAVAAAAVWGGWSYLKPEPQAAYITETVRRGDISRTVSATGEISPSNLVSVGAQASGQIKKLYVKLGQQVKKGDLIAEINSTSQTNTLNTEKSKLETYQAKLVSAQIALGSAEKKYKRQAALWKDDATAKEDLESAQDALAAAKANVAELKALIRQSKISINTAESELGYTRITATMDGTVVAILVEEGQTVNAAQSTPTIVQLANLDMMLNKMQIAEGDITKVKAGQDISFTILSEPDTPIKAKLDSVDPGLTTMSSGGYNSSTDTASNAVYYYARSFVPNPDGKLATGMTTQNTVEIDGVKNVLIIPSLTVKNRGGRAFVRVLGADGKAAEREIRTGMRDSMNTEVKSGLKEGDKVVISEITAAEQQESGERALGGPPRR

SEQ ID NO: 1217 - DNA, 798 bp, Neisseria gonorrhoeae
atgaaaaccaagttaatcaaaatcttgaccccctttaccgtcctgccgctgctggcttgcgggcaaacgcccgtttccaatgccaacgccgaatccgccgtcaaagccgaatccgccggcaaatccgttgccgcttctttgaaagcgcgtttggaaaaaacctattccgcccaagatttgaaagtgttgagcgtcagcgaaacaccggtcaaaggcatttacgaagtcgtcgtcagcggcaggcagattatctacaccgatgccgaaggcggctatatgttcgtcggcgaactcatcaacatcgacacgcgcaaaaacctgaccgaagaacgcgccgccgatttgaacaaaatcgacttcgcctccctgcctttggacaaagccatcaaagaagtacgcggcaacggcaagctgaaagtcgccgtcttctccgaccccgattgtccgttctgcaaacgcttggaacatgagtttgaaaaaatgaccgacgtgacggtttacagctttatgatgcccattgccggcctgcacccagatgccgcgcgcaaggcgcaaatcttatggtgtcagcccgaccgtgccaaagcgtggacggattggatgcgtaaaggcaaattcccggtcggcggcagcatctgcgacaatcccgtcgcggaaaccacttccttgggcgaacagttcggcttcaacggcacgccgacccttcgtcttccccaacgggcgcacccaaagcggttacagcccgatgccccaactggaggaaatcatccgcaaaaaccagcagtaaacccgcaatga

SEQ ID NO: 1218 - protein, 265 aa, Neisseria gonorrhoeae
MKTKLIKILTPFTVLPLLACGQTPVSNANAESAVKAESAGKSVAASLKARLEKTYSAQDLKVLSVSETPVKGIYEVVVSGRQIIYTDAEGGYMFVGELINIDTRKNLTEERAADLNKIDFASLPLDKAIKEVRGNGKLKVAVFSDPDCPFCKRLEHEFEKMTDVTVYSFMMPIAGLHPDAARKAQILWCQPDRAKAWTDWMRKGKFPVGGSICDNPVAETTSLGEQFGFNGTPTLRLPQRAHPKRLQPDAPTGGNHPQKPAVNPQ

SEQ ID NO: 1219 - DNA, 783 bp, Neisseria meningitidis
atgaaaaccaagttaatcaaaatcttgaccccctttaccgtcctcccgctgctggcttgcgggcaaacgcccgtttccaatgccaacgccgaacccgccgtcaaagccgagtccgccggcaaatccgttgccgcctctttgaaagcgcgtttggaaaaaacctattccgcccaagatttgaaagtgttgagcgtcagcgaaacaccggtcaaaggcatttacgaagtcgtcgtcagcggcaggcagattatctacaccgatgccgaaggcggctatatgttcgtcggcgaactcatcaacatcgacacgcgcaaaaacctgaccgaagaacgcgccgccgatttgaacaaaatcgacttcgcctccctgcctttggacaaagccatcaaagaagtgcgcggcaacggcaagctgaaagtcgccgtcttctccgaccccgattgtccgttctgcaaacgcttggaacacgagtttgaaaaaatgaccgacgtgacggtttacagctttatgatgcccattgccggcctgcaccccgatgccgcgcgcaaggcgcaaatcttatggtgtcagcccgaccgcgccaaagcgtggacggattggatgcgtaaaggcaaattcccggtcggcggcagcatctgcgacaatcccgtcgcggaaaccacttccttgggcgaacaattcggcttcaacggcacgccgaccctcgtcttccccaacgggcgcagccaaagcggctacagcccgatgccccaactggaggaaatcatccgcaaaaatcaataa

SEQ ID NO: 1220 - protein, 260 aa, Neisseria meningitidis
MKTKLIKILTPFTVLPLLACGQTPVSNANAEPAVKAESAGKSVAASLKARLEKTYSAQDLKVLSVSETPVKGIYEVVVSGRQIIYTDAEGGYMFVGELINIDTRKNLTEERAADLNKIDFASLPLDKAIKEVRGNGKLKVAVFSDPDCPFCKRLEHEFEKMTDVTVYSFMMPIAGLHPDAARKAQILWCQPDRAKAWTDWMRKGKFPVGGSICDNPVAETTSLGEQFGFNGTPTLVFPNGRSQSGYSPMPQLEEIIRKNQ

SEQ ID NO: 1221 - DNA, 783 bp, Neisseria meningitidis; identical to SEQ ID NO: 1219

SEQ ID NO: 1222 - protein, 260 aa, Neisseria meningitidis; identical to SEQ ID NO: 1220

SEQ ID NO: 1223 - DNA, 619 bp, Neisseria gonorrhoeae
atgcgtattacctgtgcgccgatgtcgcttttgtcggcggcagtctggtcggttcgggctgtcagaacatcatcgaaccgctttcctgcggcgttacgacgatattcggcttttcgacctacaatttttccgaagcctgccggcacgccttggcatcgggtgcggcggttcaagtcgaatcggcggacgcgtggcgtgaagccgttgaaaaaaccttatctggcgaggggggcggaatgcagatgcaggcgcgcgtggacggctttatcgcacaacatcgcggagcgggcgcgagaatcgccgaggcggtgcgggaagcggtatgcggacatcgggggcgatagtgatacaatccgtatccgagttttccggttggagcatcgtatgagtatttatgccgtcgcgcacatcatccacctgtattgcgccaccgcctttgtcggcggcgtgttttttgaagtgctggttttgtccgtcctgcatacgggacgggtgtcgcgcgaggcgcggcgcgaagtggaaaaggcaatgtcttaccgcgccgtcagggtgatgccgtttgcggtcggactgctgttcgccaggggaactctagagtcgactgcagcagcatgccctc

SEQ ID NO: 1224 - protein, 206 aa, Neisseria gonorrhoeae
MRITCAPMSLLSAAVWSVRAVRTSSNRFPAALRRYSAFRPTIFPKPAGTPWHRVRRFKSNRRTRGVKPLKKPYLARGAECRCRRAWTALSHNIAERARESPRRCGKRYADIGGDSDTIRIRVFRLEHRMSIYAVAHIIHLYCATAFVGGVFFEVLVLSVLHTGRVSREARREVEKAMSYRAVRVMPFAVGLLFARGTLESTAAACP

SEQ ID NO: 1225 - DNA, 834 bp, Neisseria meningitidis
atgcgtattacctgtgcgccgatgtcgcttttgtcggcggcagtctggtcgattcgggttgtcagaacatcatcgaaccgctttcctgcggcgttccgacgatattcggcttttcaacctacaatttttccgaagcctgccgacacgccttggcatcgggtgcggcggttcaagtcgaatcggcggatgcgtggcgggaagccgttgaaaaaaccttatcgtccgaggggggggggatgcagatgcaggcgcgcgtggacggctttatcgcacaacatcgcggagcgggcgcgagaatcgccgaggcggtgcgggaagcggtatgcggatatcgggggcgatagtgatacaatccgtatccgagttttccgtttggagcatcgtatgagtatttatgccgtcgcgcacatcgttcatctgtattgcgctattgcctttgtcggcggcgtgttttttgaagtgctggttttgtccgtcctgcatacgggacgggtgtcgcgcgaggcgcggcgcgaagtggaaaaggcaatgtcttaccgcgccgtcagggtgatgccgtttgtggtcggactgctgttcgccagcggcatcgtgatggcggcaaaccgctatctttctatattgggcgaaccgtttgccacttccttcggtacgatgctgacgctgaaaatcctgttggcgttcagcgtattggcgcacttcgccatcgccgtcgtcaaaatggcgcgttccacactgacggtcggttggtcgaaatacatacacgccgtcgtctttacccatatgctgctgattgtctttttggcaaaagcgatgttttatatcagctggtaa

SEQ ID NO: 1226 - protein, 277 aa, Neisseria meningitidis
MRITCAPMSLLSAAVWSIRVVRTSSNRFPAAFRRYSAFQPTIFPKPADTPWHRVRRFKSNRRMRGGKPLKKPYRPRGGGCRCRRAWTALSHNIAERARESPRRCGKRYADIGGDSDTIRIRVFRLEHRMSIYAVAHIVHLYCAIAFVGGVFFEVLVLSVLHTGRVSREARREVEKAMSYRAVRVMPFVVGLLFASGIVMAANRYLSILGEPFATSFGTMLTLKILLAFSVLAHFAIAVVKMARSTLTVGWSKYIHAVVFTHMLLIVFLAKAMFYISW

SEQ ID NO: 1227 - DNA, 834 bp, Neisseria meningitidis
atgcgtattacctgtgcgccgatgtcgcttttgtcggcggcagtctggtcgattcgggctgtcagaacatcatcgaaccgctttcctgcggcgttccgacgatattcggcttttcgacctacaatttttccgaagcctgccggcacgccttggcatcgggtgcggcggttcaagtcgaatcggcggacgcgtggcgggaagccgttgaaaaaaacttatcgtccgaggagggcggaatgcagatgcaggcgcgcgcggacggctttatcgcacaacatcgcggagcgggcgcgagaatcgccgaggcggtacgggaagcggtatgcggacatcggggacgatagtgatacaatccgtatccgagttttccggttggagtaccgtatgagtatttatgccgtcgcgcacatcgtccacctgtattgcgccatcgcctttgtcggcggcgtgttttttgaagtgctggttttgtccgtcctgcatacgggacgggtgtcgtgcgaggcgcggcgcgaagtggaaaaggcaatgtcttaccgcgccgtcagggtgatgccgtttgtggtcggactgctgttcgccagcggcatcgtgatggcggcaaaccgctatctttctatattgggcgaaccgtttgccacttccttcggtacgatgctgacgctgaaaatcctgttggcgttcagcgtgttggcgcacttcgccatcgccgtcgtcaaaatggcgcgttccacactgaccgtcggctggtcgaaatacatacacaccgtcgtctttacccatatgctgctgattgtctttttggcaaaagcgatgttttatatcagctggtaa

SEQ ID NO: 1228 - protein, 277 aa, Neisseria meningitidis
MRITCAPMSLLSAAVWSIRAVRTSSNRFPAAFRRYSAFRPTIFPKPAGTPWHRVRRFKSNRRTRGGKPLKKTYRPRRAECRCRRARTALSHNIAERARESPRRYGKRYADIGDDSDTIRIRVFRLEYRMSIYAVAHIVHLYCAIAFVGGVFFEVLVLSVLHTGRVSCEARREVEKAMSYRAVRVMPFVVGLLFASGIVMAANRYLSILGEPFATSFGTMLTLKILLAFSVLAHFAIAVVKMARSTLTVGWSKYIHTVVFTHMLLIVFLAKAMFYISW

SEQ ID NO: 1229 - DNA, 885 bp, Neisseria gonorrhoeae
atgctcgggatggcgcggcacgacggccagcagggcatcgccgcgatattgttgccacgccgccagcagtttttccgcctcgtcttcgccccgataaacgcgcgtgctgccgcacacggcaaccggccggcctccgatgcgtttttcaaactgccccgccagcgttttcatgtcttcagacggcatcaggtcgtatttggtattgccgcacacctgcacggatgccgcgcccaatttcgccaaccgcgccgcatccgcctccgtctgcgccagacagcccgtcagcgaagcggctgcgggacggatcaggcggcggactttcagataaccgttcagcgatttttccgacagccgcgcattcgccaaaaacagcggcacacccgctcgccggcattccttcatcagattgggccagatttcggtttccatcaaaatgccgaacatcgggcggtgttcgcgcaaaaactgccgtacccacgtttttttgtcatacggaagatagcggcattgcgcatcgggaaacagaacttgcgcggtttcccgtcccgtcggggtcatctgcgtcatcagcagcggcgcatcgggaaaacgccgccgcaactcgcgtatcaagggctgggcggcacgcgtttctccgaccgaaacggcgtgtatccaaaccgcgccggtaacgggattcggatgcggcttgccgaaacgctcgtccctatgcgcccggtatgccggggcacttccggagcgtttgtccaaataacgccgtatccatatcggcgcaagcagccacaatacatcataaagccattggaacatctttctatttcctgcaaaacaaatgccgtccgaacggttcggacggcatttcggcaacggaatcaaatatcgtag

SEQ ID NO: 1230 - protein, 294 aa, Neisseria gonorrhoeae
MLGMARHDGQQGIAAILLPRRQQFFRLVFAPINARAAAHGNRPASDAFFKLPRQRFHVFRRHQVVFGIAAHLHGCRAQFRQPRRIRLRLRQTARQRSGCGTDQAADFQITVQRFFRQPRIRQKQRHTRSPAFLHQIGPDFGFHQNAEHRAVFAQKLPYPRFFVIRKIAALRIGKQNLRGFPSRRGHLRHQQRRIGKTPPQLAYQGLGGTRFSDRNGVYPNRAGNGIRMRLAETLVPMRPVCRGTSGAFVQITPYPYRRKQPQYIIKPLEHLSISCKTNAVRTVRTAFRQRNQIS

SEQ ID NO: 1231 - DNA, 885 bp, Neisseria meningitidis
atgctcgggatggcgcggcacgacgaccagcagcgcatcgccgcgatattgttgccacgccgccagcagtttttccgcctcgtcttcaccccgataaacgcgcgtgctgccgcacacggcaaccggccggcctccgatgcgtttttcaaactgccccgccagcgttttcatctgttccgacggtatgatgtcgtatttggtattgccgcacacctgcacggatgccgcgcccaatttcgccaaccgcgccgcatccgcctctgtctgcgccagacaccccgtcagcgaagcggcggcaggacggatcaggcggcggactttcagataaccgttcaacgatttttccgacagccgcgcattcgccaaaaacagcggcacacccgcgcgccggcattccctcatcaggttgggccagatttcggtttccatcaaaatgccgaacatcgggcggtgttcgcgcaaaaactgccgtacccacgtttttttgtcatacggaagatagcggcattgcgcatcgggaaacagaacttgcgcggtttcccgccccgtcggggtcatctgcgtcatcagcagcggcgcatcgggaaaacgccgccgcaactcgcgtatcaaggactgggcggcacgcgtttctccgaccgaaacggcgtgtatccaaaccgcgccggtaacgggattcggatacggcttgccgaaacgctcgtcccgatgcgcccgatatgccggggcacttccggagcgtttgtccaaataacgccgtatccatatcggcgcaagcagccacaatacatcataaagccattggaacatctttctatttcctgcaaaacaaatgccgtctgaacggttcagacggcatttcggcaacggaatcaaatatcgtag

SEQ ID NO: 1232 - protein, 294 aa, Neisseria meningitidis
  misc_feature (281)..(281): Xaa can be any naturally occurring amino acid
MLGMARHDDQQRIAAILLPRRQQFFRLVFTPINARAAAHGNRPASDAFFKLPRQRFHLFRRYDVVFGIAAHLHGCRAQFRQPRRIRLCLRQTPRQRSGGRTDQAADFQITVQRFFRQPRIRQKQRHTRAPAFPHQVGPDFGFHQNAEHRAVFAQKLPYPRFFVIRKIAALRIGKQNLRGFPPRRGHLRHQQRRIGKTPPQLAYQGLGGTRFSDRNGVYPNRAGNGIRIRLAETLVPMRPICRGTSGAFVQITPYPYRRKQPQYIIKPLEHLSISCKTNAVXTVQTAFRQRNQIS

SEQ ID NO: 1233 - DNA, 885 bp, Neisseria meningitidis
atgctcgggatggcgcggcacgacgaccagcagggcatcgccgcgatattgttgccacgccgccagcagtttttccgcctcgtcttcaccccgataaacgcgcgtgctgccgcacacggcaacctgccggtctccgatgcgtttttcaaactgccccgccagcgttttcatctgttccgacggcatcaggtcgtatttggtattgccgcacacctgcacggatgccgcgcccaatttcgccaaccgcgccgcatccgcctccgtctgtgccagacagcccgtcagcgaagcggcggcaggacggatcaggctgcggactttcagataaccgtttagcgatttttccgacagccgcgcattcgccaaaaacagcggcacacccgtgcgccggcattccttcatcagattgggccagatttcggtttccatcaaaatgccgaacatcgggcggtgttcgcgcaaaaactgccgtacccacgtttttttgtcatacggaagatagcggcattgtgcatcaggaaacagaacttgcgcggtttcccgtcccgtcggggtcatctgcgtcatcagcagcggcgcatcgggaaaacgctgccgcaactcgcgtatcaaaggttgggcggcacgcgtttccccgaccgaaacggcgtgtatccaaaccgcgccggtaacgggattcggatacggcttgccgaaacgctcgccccgatgcgcccgatatgcaggggcacttccggagcgtttgtccaaataacgccgtatccatatcggcgcaagcagccacaatacatcataaagccattggaacatctttctatttcctgcaaaacaaatgccgtccgaacggttcggacggcatttcggcaacggaatcaaatatcgtag

SEQ ID NO: 1234 - protein, 293 aa, Neisseria meningitidis
MLGMARHDDQQGIAAILLPRRQQFFRLVFTPINARAAAHGNLPVSDAFFKLPRQRFHLFRRHQVVFGIAAHLHGCRAQFRQPRRIRLRLCQTARQRSGGRTDQAADFQITVRFFRQPRIRQKQRHTRAPAFLHQIGPDFGFHQNAEHRAVFAQKLPYPRFFVIRKIAALCIRKQNLRGFPSRRGHLRHQQRRIGKTLPQLAYQRLGGTRFPDRNGVYPNRAGNGIRIRLAETLAPMRPICRGTSGAFVQITPYPYRRKQPQYIIKPLEHLSISCKTNAVRTVRTAFRQRNQIS

SEQ ID NO: 1235 - DNA, 1293 bp, Neisseria gonorrhoeae
atggctgtcttcccactttcggcaaaacatcggaaatacgcgctgcgcgcgcttgccgtttcgattattctggtgtcggcggcatacattgcttcgacagaggggaccgagcgcgtcagaccgcagcgcgtggaacaaaaactgccgccgctgtcttggggcggcaacggcgttcagacggcatattgggtgcaggaggcggtgcagccgggggactcgctggcggacgtgctggcgcgttcgggtatggcgcgggacgagattgcccgaatcacggaaaaatatggcggcgaagccgatttgcggcatttgcgtgccgaccagtcggttcatgttttggtcggcggcgacggcagtgcgcgcgaagtgcagttttttaccgacgaagacggcgagcgcaatctggtcgctttggaaaaaaaaggcggcatatggcggcggtcggcttctgatgcggatatgaaggttttgccgacactgcgttcggtcgtggtcaaaacgtcggcgcgcggttcgctggcgcgggcggaagtgcccgtcgaaatccgcgaatccttaagcgggatttttgccggccgcttcagccttgacggtttgaaggaaggcgatgccgtgcgcctgctttacgacagcctgtatttccacgggcagcaggtggcggcgggcgatattttggcggcggaagttgtcaagggcggcacaacccatcaggcgttctattaccgttcggacaaggaaggcggagggggcggcaattattacgatgaagacggcagggtgttgcaggaaaaaggcggcttcaacatcgagccgctggtctatacgcgcatttcttcgccgttcggctaccgtatgcaccccatcctgcacacatggcggctgcacacgggcatcgattatgccgcaccgcagggaacgccggtcagggcttccgccgacggcgtgattacctttaaaggccggaagggcggatacggcaacgcggtgatgatacgccacgccaacggtgtggaaacgctgtacgcgcacttgagcgcgttttcgcaggcacaaggcaatgtgcgcggcggcgaggtcatcggttttgtcggttcgacagggcgttcgaccgggccgcacctgcattacgaggcgcgcatcaacgggcagcccgtcaatcctgtttcggtcgcattgccgacacccgaattgacgcaggcggacaaggcggcgtttgccgcgcagaaacagaaggcggacgcgctgcttgcgcgcttgcgcggcataccggttaccgtgtcgcaatcggattga

SEQ ID NO: 1236 - protein, 380 aa, Neisseria gonorrhoeae
LSWGGNGVQTAYWVQEAVQPGDSLADVLARSGMARDEIARITEKYGGEADLRHLRADQSVHVLVGGDGSAREVQFFTDEDGERNLVALEKKGGIWRRSASDADMKVLPTLRSVVVKTSARGSLARAEVPVEIRESLSGIFAGRFSLDGLKEGDAVRLLYDSLYFHGQQVAAGDILAAEVVKGGTTHQAFYYRSDKEGGGGGNYYDEDGRVLQEKGGFNIEPLVYTRISSPFGYRMHPILHTWRLHTGIDYAAPQGTPVRASADGVITFKGRKGGYGNAVMIRHANGVETLYAHLSAFSQAQGNVRGGEVIGFVGSTGRSTGPHLHYEARINGQPVNPVSVALPTPELTQADKAAFAAQKQKADALLARLRGIPVTVSQSD

SEQ ID NO: 1237 - DNA, 1293 bp, Neisseria meningitidis
atggctgtcttcccactttcggcaaaacatcggaaatacgcgctgcgtgcgcttgccgtttcgattattttggtgtcggcggcatacattgcttcgacagagaggacggagcgcgtcagaccgcagcgcgtggaacaaaatctgccgccgctgtcttggggcggcagcggcgttcagacggcatattgggtgcaggaggcggtgcagccgggcgactcgctggcggacgtgctggcgcgttcgggtatggcgcgggacgagattgcccgaatcacggaaaaatatggcggcgaagccgatttgcggcatttgcgtgccgaccagtcggttcatgttttggtcggcggcgacggcggcgcgcgcgaagtgcagttttttaccgacgaagacggcgagcgcaatctggtcgctttggaaaagaaaggcggcatatggcggcggtcggcttctgaggcggatatgaaggttttgccgacgctgcgttcggtcgtggtcaaaacgtcggcgcgcggttcgctggcgcgggcggaagtgcccgtcgaaatccgcgaatccttaagcgggattttcgccggccgcttcagccttgacggtttgaaggaaggcgatgccgtgcgcctgatgtacgacagcctgtatttccacgggcagcaggtggcggcgggcgatattttggcggctgaagtcgttaagggcggcacaaggcatcaggcgttctattaccgttcggacaaggaaggcggagggggcggcaattattatgatgaagacggcaaggtgttgcaggaaaaaggcggcttcaacatcgagccgctggtctatacgcgcatttcttcgccgttcggctaccgtatgcaccccatcctgcacacatggcggctgcacacgggcatcgattatgccgcaccgcagggaacgccggtcagggcttccgccgacggcgtgattacctttaaaggccggaagggcggatacggcaacgcggtgatgatacgccacgccaacggtgtggaaacgctgtacgcgcacttgagcgcgttttcgcaggcggaaggcaatgtgcgcggcggcgaggtcatcggttttgtcggttcgaccgggcgttcgaccgggccgcacctgcattacgaggcgcgcatcaacgggcagcccgtcaatcctgtttcggtcgcattgccgacaccggaattgacgcaggcggacaaggcggcgtttgccgcgcagaaacagaaggcggacgcgctgcttgcgcgcttgcgcggcataccggttaccgtgtcgcaatcggattga

SEQ ID NO: 1238 - protein, 430 aa, Neisseria meningitidis
MAVFPLSAKHRKYALRALAVSIILVSAAYIASTERTERVRPQRVEQNLPPLSWGGSGVQTAYWVQEAVQPGDSLADVLARSGMARDEIARITEKYGGEADLRHLRADQSVHVLVGGDGGAREVQFFTDEDGERNLVALEKKGGIWRRSASEADMKVLPTLRSVVVKTSARGSLARAEVPVEIRESLSGIFAGRFSLDGLKEGDAVRLMYDSLYFHGQQVAAGDILAAEVVKGGTRHQAFYYRSDKEGGGGGNYYDEDGKVLQEKGGFNIEPLVYTRISSPFGYRMHPILHTWRLHTGIDYAAPQGTPVRASADGVITFKGRKGGYGNAVMIRHANGVETLYAHLSAFSQAEGNVRGGEVIGFVGSTGRSTGPHLHYEARINGQPVNPVSVALPTPELTQADKAAFAAQKQKADALLARLRGIPVTVSQSD

SEQ ID NO: 1239 - DNA, 1293 bp, Neisseria meningitidis
atggctgtcttcccactttcggcaaaacatcggaaatacgcgctgcgcgcgcttgccgtttcgattattttggtgtcggcggcatacattgcttcgacagagaggacggagcgcgtcagaccgcagcgcgtggaacaaaaactgccgccgctgtcttggggcggcagcggtgttcagacggcatattgggtgcaggaggcggtgcagccaggcgactcgctggcggacgtgctggcgcgttcgggtatggcgcgggacgaaattgcccgaataacggaaaaatatggcggcgaagccgatttgcggcatttgcgtgccgaccagtcggttcatgttttggtcggcggcgacggcggcgcgcgcgaagtgcagttttttaccgacgaagacggcgagcgcaatctggtcgctttggaaaaaaaaggcggcatatggcggcggtcggcttctgaggcggatatgaaggttttgccgacgctgcgttcggtcgtggtcaaaacgtcggcgcgcggttcgctggcgcgggcggaagtgcccgtcgaaattcgcgaatccttaagcgggattttcgccggccgcttcagccttgatggtttgaaggaaggcgatgccgtgcgcctgatttacgacagcctgtatttccacgggcagcaggtggcggcgggcgatattctggcggcggaagtcgttaagggcggcacaaggcatcaggcgttctattaccgttcggacaaggaaggaggagggggcggcaattattacgatgaagacggcagggtgttgcaggaaaaaggcggcttcaacatcgagccactggtctatacgcgcatttcttcgccgttcggctaccgtatgcaccccatcctgcacacttggcggctgcacacgggcatcgattatgccgcaccgcagggaacgccggtcagggcttccgccgacggcgtgattacctttaaaggccggaagggtggctacggcaacgcggtgatgatacgccacgccaacggtgtggaaacgctgtatgcgcacttgagcgcgttttctcaggcagaaggcaatgtgcgcggcggcgaggtcatcggttttgtcggttcgaccgggcgttcgacggggccgcacctgcattacgaggcgcgcatcaatgggcagcccgtcaatcctgtttcggtcgcattgccgacacccgaattgacgcaggcggacaaggcggcgtttgccgcgcagaaacagaaggcggacgcgctgcttgcgcgcttgcgcggcataccggttaccgtgtcgcaatcggattga

SEQ ID NO: 1240 - protein, 430 aa, Neisseria meningitidis
MAVFPLSAKHRKYALRALAVSIILVSAAYIASTERTERVRPQRVEQKLPPLSWGGSGVQTAYWVQEAVQPGDSLADVLARSGMARDEIARITEKYGGEADLRHLRADQSVHVLVGGDGGAREVQFFTDEDGERNLVALEKKGGIWRRSASEADMKVLPTLRSVVVKTSARGSLARAEVPVEIRESLSGIFAGRFSLDGLKEGDAVRLIYDSLYFHGQQVAAGDILAAEVVKGGTRHQAFYYRSDKEGGGGGNYYDEDGRVLQEKGGFNIEPLVYTRISSPFGYRMHPILHTWRLHTGIDYAAPQGTPVRASADGVITFKGRKGGYGNAVMIRHANGVETLYAHLSAFSQAEGNVRGGEVIGFVGSTGRSTGPHLHYEARINGQPVNPVSVALPTPELTQADKAAFAAQKQKADALLARLRGIPVTVSQSD

SEQ ID NO: 1241 - DNA, 984 bp, Neisseria gonorrhoeae
atgaaaaactttctttcccttttcgcctccatactgatgtctgccctgattgccgtgtggttcagccaaaaccccatcaacgcctactggcagcagacctaccaccgcaacagcccgctcgaaccgcttgccgcctacggatggtggcggagcggagcggcgttgcaagaaaacgcctacgccctttcagacggcatcaaaaccttcctgtccggcgaaacgccccccacggctcaagacggcggttcggcagatatgccgcctgaagccgccgcatccgaagccgccccgccggccggcggaacagaatggaaacaaggcaccgaagccgccgccgtccgcagcggcgacaaagtctttttcgccggagattcgctgatgcagggcgttgcgcctttcgtgcaaaaaagcctgaaacagcaatacggcatcgaatccgccaacctcagcaaacaaagcacggggctttcctatccctcattcttcgactggccgaaaacgattgaagaaaccttgaaaaaacatcccgaaatcagcgtactcgccgtcttcctcggcccgaacgacccgtgggatttccccgtcggcaaacgctacctcaaattcgcttccgacgaatgggcgcaagaatacctgaaacgcgtcgaccgcatccttgaagccgcacacacgcaccgcgtccaagtcgtctggctcggcatcccctacatgaaaaaagtcaagctcgacggtcagatgcgctacctcgacaaactgctttcggaacacttgaaaggcaaaatcatcctgattcccaccgcgcaaacactgagcggcgggaaaggccgctacaccgattccgtcaacgtcaacggcaaacccgtccgctaccgcagtaaggacggcatacactttaccgccgaaggacaaaaactgctggcggaaaaaataatggaaaaaatcgtttttgaaccgagtacgcaaccatcaagtacacagccatga

SEQ ID NO: 1242 - protein, 327 aa, Neisseria gonorrhoeae
MKNFLSLFASILMSALIAVWFSQNPINAYWQQTYHRNSPLEPLAAYGWWRSGAALQENAYALSDGIKTFLSGETPPTAQDGGSADMPPEAAASEAAPPAGGTEWKQGTEAAAVRSGDKVFFAGDSLMQGVAPFVQKSLKQQYGIESANLSKQSTGLSYPSFFDWPKTIEETLKKHPEISVLAVFLGPNDPWDFPVGKRYLKFASDEWAQEYLKRVDRILEAAHTHRVQVVWLGIPYMKKVKLDGQMRYLDKLLSEHLKGKIILIPTAQTLSGGKGRYTDSVNVNGKPVRYRSKDGIHFTAEGQKLLAEKIMEKIVFEPSTQPSSTQP

SEQ ID NO: 1243 - DNA, 984 bp, Neisseria meningitidis
atgaaaaactttctttcccttttctcctccatactgatgtctgccctgattgccgtgtggttcagccaaaaccccatcaacgcctactggcagcagacctaccaccgcaacagcccgctcgaaccgcttgccgcctacggatggtggcggagcggtgcggcgttgcaagaaaacgcctacgccctttcagacggcatcaaagccttcctgtccggcgaaacgccgccgacggctcaagacggcggttcggcagatatgccgtctgaagccgccgcatccgaagccgtccctcaaaccggtgaaacagaatggaaacaagacaccgaagccgccgccgtccgcagcggcgacaaagtcttttttgtcggcgactcgctgatgcagggcgttgcccccttcgtgcaaaaaagcctgaaacagcaatacggcatcgaatccgtcaacctcagcaaacaaagcacggggctgtcctacccctcattcttcgactggccgaaaacgattgaagaaaccctgcaaaaacatcccgaaatcagcgtactcgccgtcttcctcggaccgaacgacccgtgggatttccccgtcggcaaactctatctcaaattcgcttccgacgaatgggcgcaagaatacctgaaacgtgtcgaccgcatccttgaagccgcacacacgcaccgcgtccaagtcgtctggctcggcatcccctacatgaaaaaagccaagctcgacggacagatgcgctacctagacaaactgctttcggaacatttgaaaggcaaaatcatcctgattcccaccacgcacaccctgagcggcgggaaagaccgctacaccgactccgtcaacgtcaacggcaaacccgtccgctaccgcagcaaggacggcatacactttaccgccgaaggacaaaaactgctggcggcaaaaataatggaaaaaatcgtttttgaaccaagtacgcaaccatcaagtacacagccatga

SEQ ID NO: 1244 - protein, 327 aa, Neisseria meningitidis
MKNFLSLFSSILMSALIAVWFSQNPINAYWQQTYHRNSPLEPLAAYGWWRSGAALQENAYALSDGIKAFLSGETPPTAQDGGSADMPSEAAASEAVPQTGETEWKQDTEAAAVRSGDKVFFVGDSLMQGVAPFVQKSLKQQYGIESVNLSKQSTGLSYPSFFDWPKTIEETLQKHPEISVLAVFLGPNDPWDFPVGKLYLKFASDEWAQEYLKRVDRILEAAHTHRVQVVWLGIPYMKKAKLDGQMRYLDKLLSEHLKGKIILIPTTHTLSGGKDRYTDSVNVNGKPVRYRSKDGIHFTAEGQKLLAAKIMEKIVFEPSTQPSSTQP

SEQ ID NO: 1245 - DNA, 984 bp, Neisseria meningitidis
atgaaaaactttctttcccttttcgcctccatactgatgtctgccctgattgccgtgtggttcagccaaaaccccatcaacgcctactggcagcagacctaccaccgcaacagcccgctcgaaccgcttgccgcctacggatggtggcggagcggtgcggcattgcaagaaaacgcctacgccctttcagacggcatcaaagccttcctgtccggcgaaacgccgccgacggctcaagacggcggttcggcagatatgccgtctgaagccgccgcacccgaaaccgcccctcaaactggcgaaacagaatggaaacaaaacaccgaagccgccgccgtccgaacaggggacaaagtctttttcgccggcgactcgctgatgcagggcgttgcacccttcgtgcaaaaaagcctgaaacagcaatacggcatcgaatccgtcaacctcagcaaacaaagcacggggctgtcctacccctcattcttcgactggccgaaaacgattgaagaaaccctgaaaaaacatcccgaaatcagcgtgctcgccgtcttcctcggtccgaacgacccgtgggatttccccgttggcaaacgctacctcaaattcgcttccgacgaatgggcgcaagaatacctgaaacgcgtcgaccgcatccttgaagccgcacacacgcactacgtccaagtcgtctggctcggcatcccctacatgaaaaaagccaagctcgacggacagatgcgctacctagacaaactgctttcggaatatttgaaaggcaaaatcatcctgattcccaccgcgcacaccctgagcggcgggaaagaccgctacaccgactccgtcaacgtcaacggcaaacccgtccgctaccgcagcaaggacggcatacactttaccgccgaaggacaaaaactgctggcggcaaaaataatggaaaaaatcgtttttgaaccaagtacgcaaccatcaagtacacagccatga

SEQ ID NO: 1246 - protein, 327 aa, Neisseria meningitidis
MKNFLSLFASILMSALIAVWFSQNPINAYWQQTYHRNSPLEPLAAYGWWRSGAALQENAYALSDGIKAFLSGETPPTAQDGGSADMPSEAAAPETAPQTGETEWKQNTEAAAVRTGDKVFFAGDSLMQGVAPFVQKSLKQQYGIESVNLSKQSTGLSYPSFFDWPKTIEETLKKHPEISVLAVFLGPNDPWDFPVGKRYLKFASDEWAQEYLKRVDRILEAAHTHYVQVVWLGIPYMKKAKLDGQMRYLDKLLSEYLKGKIILIPTAHTLSGGKDRYTDSVNVNGKPVRYRSKDGIHFTAEGQKLLAAKIMEKIVFEPSTQPSSTQP

SEQ ID NO: 1247 - DNA, 1194 bp, Neisseria gonorrhoeae
atgaaccccaaacacttcatcgcattttccgccctgttcgccgccacgcaggcagaagccctgcccgtcgcctccgtcagccccgacaccgttaccgtttccccgtccgccccctacaccgatacaaacgggctgctgaccgactacggcaacgccgccgcctcgccttggatgaaaaaactccgatccgtcgcacaaggcagcggcgaggccttccgcatcctgcaaatcggcgactcgcataccgccggcgacttctttaccgacgccctgcgcaaacgcctgcaaaaaacatggggcgacggcggcataggctgggtttaccccgccaacgtcaaagggcagcgcatggcggccgtccgtcacagcggcaactggcaaagcttcaccagcaggaacaataccggagatttcccgctcggcggcatcctcgcccaaaccggcagcggcggcggcatgaccctgaccgcgtctgacggcaaaaccggcaaacagcgcgtttccctgtttgccaaaccgctgctcgccgaacaaaccctgaccgtcaacggcaacaccgtctccgccaacggcggcggctggcaggtactggatacgggcgcggcactgcccctggccatacagaccgaaatgccgtgggacatcggcttcatcaacatcgaaaatcccgccggcggcattaccgtttccgcgatgggcatcaacggcgcacaattgacccagtggtcgaaatggcgtgccgaccgtatgaacgaccttgcccaaaccggcgccgatttggttatcctttcctacggcaccaacgaagccttcaacaacaacatcgacattgccgataccgaacaaaaatggctggataccgtccgccaaatccgcgacagcctgcccgccgccggcatcctcatcatcggcgcgcccgaatccctgaaaaacacgctcggcgtatgcggcacgcgccccgtcctcctgaccgaagtccaacagatgcagcggcgcgtcgcccgtcaggggcagacgatgttttggtcttggcaaaacgcaatgggcggcatatgcagcatgaaaaactggctcaaccaaggatgggccgccaaagacggcgtacacttctccgcccaaggctaccggcgcgcggcggaaatgcttgccgacagcctcgaagaactcgtccgcgccgccgcaatcaggcaataa

SEQ ID NO: 1248 - protein, 397 aa, Neisseria gonorrhoeae
MNPKHFIAFSALFAATQAEALPVASVSPDTVTVSPSAPYTDTNGLLTDYGNAAASPWMKKLRSVAQGSGEAFRILQIGDSHTAGDFFTDALRKRLQKTWGDGGIGWVYPANVKGQRMAAVRHSGNWQSFTSRNNTGDFPLGGILAQTGSGGGMTLTASDGKTGKQRVSLFAKPLLAEQTLTVNGNTVSANGGGWQVLDTGAALPLAIQTEMPWDIGFINIENPAGGITVSAMGINGAQLTQWSKWRADRMNDLAQTGADLVILSYGTNEAFNNNIDIADTEQKWLDTVRQIRDSLPAAGILIIGAPESLKNTLGVCGTRPVLLTEVQQMQRRVARQGQTMFWSWQNAMGGICSMKNWLNQGWAAKDGVHFSAQGYRRAAEMLADSLEELVRAAAIRQ

SEQ ID NO: 1249 - DNA, 1194 bp, Neisseria meningitidis
atgaaccccaaacacctcatcgcattttccgccctattcgccgccacgcaggcagaagccctacctgtcgcctccgtcagcctcgacaccgttaccgtttccccgtccgccccctacaccgatacaaacgggctgctgaccgactacggcaacgcctccgcctcgccttggatgaaaaaactccaatccgtcgcacaaggcagcggcgagaccttccgtatcctgcaaatcggcgactcgcataccgccggcgacttctttaccgacagcctgcgcaaacgcctgcaaaaaacttggggcgacggcggcataggctgggtttaccccgccaacgtcaaagggcagcgcatggcggccgtccggcacaacggtaactggcaaagcctcaccagcaggaacaacaccggagacttcccgctcggcggcatcctcgcccacaccggcagcggcggcagcatgaccctgaccgcatcggacggcatagcaagcaagcagcgcgtttccctgtttgccaaacccctgcttgccgaacaaaccctgaccgtcaacggcaacaccgtctccgccaacggcggcggctggcaggtactggatacgggcgcggcactgcccctgaccatacacaccgaaatgccgtgggacatcggcttcatcaacatcgaaaatcccgccggcggcattaccgtttccgcgatgggcatcaacggcgcacaattaacccagtggtcgaaatggcgtgccgaccgtatgaacgacctcgcccaaaccggcgccgatttggttatcctttcctacggcaccaacgaagctttcaacaacaacatcgacattgccgacaccgaacaaaaatggctggataccgtccgccaaatccgcgacagcctgcctgccgccggcatcctcatcatcggcgcacccgaatccctgaaaaacacgctcggcgtatgcggcacacgccccgtccgcctgaccgaagtccaacagatgcagcggcgcgtcgcccgtcaggggcagacgatgttctggtcttggcaaaacgccatgggcggcatatgcagcatgaaaaactggctcaaccaaggatgggccgccaaagacggcgtacacttctccgccaaaggctaccggcgcgcggcggaaatgctcgccgacagcctcgaagaactcgtccgctccgctgcaatcaggcaataa

SEQ ID NO: 1250 - protein, 397 aa, Neisseria meningitidis
MNPKHLIAFSALFAATQAEALPVASVSLDTVTVSPSAPYTDTNGLLTDYGNASASPWMKKLQSVAQGSGETFRILQIGDSHTAGDFFTDSLRKRLQKTWGDGGIGWVYPANVKGQRMAAVRHNGNWQSLTSRNNTGDFPLGGILAHTGSGGSMTLTASDGIASKQRVSLFAKPLLAEQTLTVNGNTVSANGGGWQVLDTGAALPLTIHTEMPWDIGFINIENPAGGITVSAMGINGAQLTQWSKWRADRMNDLAQTGADLVILSYGTNEAFNNNIDIADTEQKWLDTVRQIRDSLPAAGILIIGAPESLKNTLGVCGTRPVRLTEVQQMQRRVARQGQTMFWSWQNAMGGICSMKNWLNQGWAAKDGVHFSAKGYRRAAEMLADSLEELVRSAAIRQ

SEQ ID NO: 1251 - DNA, 1194 bp, Neisseria meningitidis
atgaaccccaaacacctcatcgcattttccgccctattcgccgccacgcaggcagaagccctacctgtcgcctcagtcagcctcgacaccgttaccgtttccccgtccgccccctacaccgatacaaacgggctgctgaccgactacggcaacgcctccgcctcgccttggatgaaaaaactccaatccgtcgcacaaggcagcggcgagaccttccgtatcctgcaaatcggcgactcgcataccgccggcgacttctttaccgacagcctgcgcaaacgcctacaaaaaacttggggcgacggcggcataggctgggtttaccccgccaacgtcaaagggcagcgcatggcggccgtccggcacaacggtaactggcaaagcctcaccagcaggaacaacaccggagacttcccgctcggcggcatcctcgcccacaccggcagcggcggcagcatgaccctgaccgcatcggacggcatagcaagcaagcagcgcgtttccctgtttgccaaacccctgcttgccgaacaaaccctgaccgtcaacggcaacaccgtctccgccaacggcggcggctggcaggtactggatacgggcgcggcactgcccctgaccatacacaccgaaatgccgtgggacatcggcttcatcaacatcgaaaatcccgccggcggcattaccgtttccgcgatgggcatcaacggcgcacaattaacccagtggtcgaaatggcgtgccgaccgtatgaacgaccttgcccaaaccggcgccgatctagtcatccttgcctacggtaccaacgaagccttcggcgacaacatcgacattgccgataccgaacagaaatggctggataccgtccgccaaatccgcgacagcctacctgccgccggcatcctcatcatcggcgcgcccgaatccctgaaaaacacgctcggcgtatgcggcacacgccccgtccgcctgaccgaagtccaacagatgcagcggcgcatcgcccgtcaggggcagacgatgttctggtcttggcaaaacgcgatgggcggcgtttgcagcatgaaaaactggctcaaccacggatgggccgccaaagacggcgtacacttttccgccaaaggctaccaacggtcggcggaaatgctcgccgacagcctcgaagaactcgtccgctccgctgcaatcaggcaataa

SEQ ID NO: 1252 - protein, 397 aa, Neisseria meningitidis
MNPKHLIAFSALFAATQAEALPVASVSLDTVTVSPSAPYTDTNGLLTDYGNASASPWMKKLQSVAQGSGETFRILQIGDSHTAGDFFTDSLRKRLQKTWGDGGIGWVYPANVKGQRMAAVRHNGNWQSLTSRNNTGDFPLGGILAHTGSGGSMTLTASDGIASKQRVSLFAKPLLAEQTLTVNGNTVSANGGGWQVLDTGAALPLTIHTEMPWDIGFINIENPAGGITVSAMGINGAQLTQWSKWRADRMNDLAQTGADLVILAYGTNEAFGDNIDIADTEQKWLDTVRQIRDSLPAAGILIIGAPESLKNTLGVCGTRPVRLTEVQQMQRRIARQGQTMFWSWQNAMGGVCSMKNWLNHGWAAKDGVHFSAKGYQRSAEMLADSLEELVRSAAIRQ

SEQ ID NO: 1253 - DNA, 1602 bp, Neisseria gonorrhoeae
atgcactcaatatatttttttaaggagaagcagatgagtcaaaccgacgcgcgtcgtagcggacgatttttacgcacagtcgaatggctgggcaatatgttgccgcacccggttacgctttttattattttcattgtgttattgctgattgcctctgccgtcggtgcgtatttcggactatccgtccccgatccgcgtcctgttggggcgaaaggacgtgccgatgacggtttgattcacgttgtcagcctgctcgatgccgacggtttgatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatccccacgcaaactcactacttttatggttgtttttacagggattttatccaatacggcttctgaattgggctatgtcgtcctaatccctttgtccgccgtcatctttcattcgctcggccgccatccgcttgccggtttggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggcagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggcaggcgtggtgtttgttgccttatccgccctattggcttggagcatcgtccctgccgacggtattttgcgtcatcctgaaacaggattggttgccggttcgccgtttttaaaatcgattgttgtttttattttcttgttgtttgcgctgccgggcattgtttatggccggataacccgaagtttgcgcggcgaacgggaagtcgttaatgcgatggccgaatcgatgagtactttgggactttatttggtcatcatcttttttgccgcacagtttgtcgcattttttaattggacgaatattgggcaatatattgccgttaaaggggcggtgttcttaaaagaagtcggcttgggcggcagtgtgttgtttatcggttttattttaatttgtgcttttatcaatctgatgataggctccgcctccgcgcaatgggcggtaactgcgccgattttcgtccctatgctgatgttggccggctacgcgccccaagtcattcaagccgcttaccgcatcggtgattccgttaccaatattattacgccgatgatgagttatttcgggctgattatggcgacggtaatcaaatacaaaaaagatgcgggcgtaggcacgctgatttctatgatgttgccgtattccgctttcttcttaattgcatggatcgccttattctgcatttgggtatttgttttgggtctgcccgtcggtcccggcacacccacattctatccggtgccttaa

SEQ ID NO: 1254 - protein, 533 aa, Neisseria gonorrhoeae
MHSIYFFKEKQMSQTDARRSGRFLRTVEWLGNMLPHPVTLFIIFIVLLLIASAVGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAVIFHSLGRHPLAGLAAAFAGVSGGYSANLFLGTIDPLLAGITQQAAQIIHPDYVVGPEANWFFMAASTFVIALIGYFVTEKIVEPQLGPYQSDLSQEEKDIRHSNEITPLEYKGLIWAGVVFVALSALLAWSIVPADGILRHPETGLVAGSPFLKSIVVFIFLLFALPGIVYGRITRSLRGEREVVNAMAESMSTLGLYLVIIFFAAQFVAFFNWTNIGQYIAVKGAVFLKEVGLGGSVLFIGFILICAFINLMIGSASAQWAVTAPIFVPMLMLAGYAPQVIQAAYRIGDSVTNIITPMMSYFGLIMATVIKYKKDAGVGTLISMMLPYSAFFLIAWIALFCIWVFVLGLPVGPGTPTFYPVP

SEQ ID NO: 1255 - DNA, 1581 bp, Neisseria meningitidis
atgcactcaatatatttttttaaggagaagcagatgagtcaaaccgatacgcaacgggacggacgatttttacgcacagtcgaatggctgggcaatatgttgccgcatccggttacgctttttattattttcattgtgttattgctgattgcctctgccgtcggtgcgtatttcggactatccgtccccgatccgcgccctgttggtgcgaaaggacgtgccgatgacggtttgatttacattgtcagcctgctcaatgccgacggttttatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatcgccacgcaaactcactacttttatggttgtttttacagggattttatctaataccgcttctgaattgggctatgtcgtcctaatccctttgtccgccatcatctttcattccctcggccgccatccgcttgccggtctggctgcggctttcgccggcgtttcgggcggttattcggccaatctgttcttaagcacaatcgatccgctcttggcatgcatcacccatcaggcggcggtcgtaggccctgaagccaactggttttttatggtagccagtacgtttgtgattgctttgattggttattttgttactgaaaaaatcgtcgaaccgcaattgggcccttatcaatcagatttgtcacaagaagaaaaagacattcggcattccaatgaaatcacgcctttggaatataaaggattaatttgggctggcgtggtgtttgttgccttatccgccctattggcttggagcatcgtccctgccgacggtattttgcgtcatcctgaaacaggattggtttccggttcgccgtttttaaaatcgattgttgtttttattttcttgttgtttgcactgycgggcmttgtttatggmcgggtaacccgaagtttgcgcggcgaacaggaagtcgttaatgcgatggccgaatcgatgagtactctggsgctttmtttgswcakcatcttttttgccgcacagtttgtcgcattttttaattggacgaatattgggcaatatattgccgttaaaggggcgacgttcttaaaagaagtcggcttgggcggcagcgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtgatcaaatacaaaaaagatgcgggcgtgggtacgctgatttctatgatgttgccgtattccgctttcttcttgattgcgtggattgccttattctgcatttgggtatttgttttgggcctgcccgtcggtcccggcgcgcccacattctatcccgcaccttaa

SEQ ID NO: 1256 - protein, 526 aa, Neisseria meningitidis
  misc_feature (330)..(330): Xaa can be any naturally occurring amino acid
  misc_feature (332)..(332): Xaa can be any naturally occurring amino acid
  misc_feature (359)..(359): Xaa can be any naturally occurring amino acid
  misc_feature (361)..(361): Xaa can be any naturally occurring amino acid
  misc_feature (363)..(364): Xaa can be any naturally occurring amino acid
MHSIYFFKEKQMSQTDTQRDGRFLRTVEWLGNMLPHPVTLFIIFIVLLLIASAVGAYFGLSVPDPRPVGAKGRADDGLIYIVSLLNADGFIKILTHTVKNFTGFAPLGTVLVSLLGVGIAEKSGLISALMRLLLTKSPRKLTTFMVVFTGILSNTASELGYVVLIPLSAIIFHSLGRHPLAGLAAAFAGVSGGYSANLFLSTIDPLLACITHQAAVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALXGXVYGRVTRSLRGEQEVVNAMAESMSTLXLXLXXIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGAPTFYPAP

SEQ ID NO: 1257 - DNA, 1602 bp, Neisseria meningitidis
atgcactcaatatatttttttaaggagaagcagatgagtcaaaccgatacgcaacgggacggacgatttttacgcacagtcgaatggctgggcaatatgttgccgcacccggttacgctttttattattttcattgtgttattgctgattgcctctgccgccggtgcgtatttcggactatccgtccccgatccgcgccctgttggtgcgaaaggacgtgccgatgacggtttgattcacgttgtcagcctgctcgatgctgacggtttgatcaaaatcctgacgcataccgttaaaaatttcaccggtttcgcgccgttgggaacggtgttggtttctttattgggcgtggggattgcggaaaaatcgggcttgatttccgcattaatgcgcttattgctcacaaaatctccacgcaaactcactacttttatggttgtttttacagggattttatctaataccgcttctgaattgggctatgtcgtcctaatccctttgtccgccatcatctttcattccctcggccgccatccgcttgccggtctggctgcggctttcgccggcgtttcgggcggttattcggccaatctgttcttaggcacaatcgatccgctcttggcaggcatcacccaacaggcggcgcaaatcatccatcccgactacgtcgtaggccctgaagccaactggttttttatggtagccagtacgtttgtgattgctttgattggttattttgttactgaaaaaatcgtcgaaccgcaattgggcccttatcaatcagatttgtcacaagaagaaaaagacattcgacattccaatgaaatcacgcctttggaatataaaggattaatttgggctggcgtggtgtttgttgccttatccgccctattggcttggagcatcgtccctgccgacggtattttgcgtcatcctgaaacaggattggtttccggttcgccgtttttaaaatcaattgttgtttttattttcttgttgtttgcactgccgggcattgtttatggccgggtaacccgaagtttgcgcggcgaacaggaagtcgttaatgcgatggccgaatcgatgagtactctggggctttatttggtcatcatcttttttgccgcacagtttgtcgcattttttaattggacgaatattgggcaatatattgccgttaaaggggcgacgttcttaaaagaagtcggcttgggcggcagcgtgttgtttatcggttttattttaatttgtgcttttatcaatctgatgataggctccgcctccgcgcaatgggcggtaactgcgccgattttcgtccctatgctgatgttggccggctacgcgcccgaagtcattcaagccgcttaccgcatcggtgattccgttaccaatattattacgccgatgatgagttatttcgggctgattatggcgacggtgatcaaatacaaaaaagatgcgggcgtgggtacgctgatttctatgatgttgccgtattccgctttcttcttgattgcgtggattgccttattctgcatttgggtatttgttttgggcctgcccgtcggtcccggcgcgcccacattctatcccgcaccttaa

SEQ ID NO: 1258 - protein, 533 aa, Neisseria meningitidis
MHSIYFFKEKQMSQTDTQRDGRFLRTVEWLGNMLPHPVTLFIIFIVLLLIASAAGAYFGLSVPDPRPVGAKGRADDGLIHVVSLLDADGLIKILTHTVKNFTGFAPLGTVLVSLLGVGIAEKSGLISALMRLLLTKSPRKLTTFMVVFTGILSNTASELGYVVLIPLSAIIFHSLGRHPLAGLAAAFAGVSGGYSANLFLGTIDPLLAGITQQAAQIIHPDYVVGPEANWFFMVASTFVIALIGYFVTEKIVEPQLGPYQSDLSQEEKDIRHSNEITPLEYKGLIWAGVVFVALSALLAWSIVPADGILRHPETGLVSGSPFLKSIVVFIFLLFALPGIVYGRVTRSLRGEQEVVNAMAESMSTLGLYLVIIFFAAQFVAFFNWTNIGQYIAVKGATFLKEVGLGGSVLFIGFILICAFINLMIGSASAQWAVTAPIFVPMLMLAGYAPEVIQAAYRIGDSVTNIITPMMSYFGLIMATVIKYKKDAGVGTLISMMLPYSAFFLIAWIALFCIWVFVLGLPVGPGAPTFYPAP

SEQ ID NO: 1259 - DNA, 822 bp, Neisseria gonorrhoeae
atggattttttgattgtcctgaaagccctgatgatgggcttggtagaaggttttaccgaatttttaccgatttccagcaccggacatttgattgtgttcggcaatctgattggttttcacagcaatcacaaggtttttgaaattgccatccagctcggtgcggttttggcggtagtgtttgaataccggcagcgtttcagcaatgtgttgcatggcgtgggaaaagaccggaaagccaaccgtttcgtcctcaatcttgccattgcttttatacctgccgccgtgatggggctgttgttcgacaaacaaatcaaagagtatctgtttaaccccttgagtgttgcagtcatgctggttttgggcggtttttttattttgtgggtggagaaacgccaaagccgagcagagcctaaaattgccgatgttgatgcattgcgtccgattgatgcgttgatgatcggtgttgcccaagtgtttgcactggttccgggtacgtcccgttcgggcagtacggttatgggcgggatgctttggggaatcgagcggaaaacggcaacggagttttcatttttcttggccgttccgatgatggttgcagcaacggcttatgatgtcctgaaacattaccgatttttcaccctgcatgatgtcggtttgattttgataggctttattgccgcttttgtttccggtttggtagcggttaaagcactgctgaagtttgtttccaagaaaaactatatcccgtttgcctattaccgcattgttttcggcattgtcatcataatattgtggttgtcgggctggataagttgggaatga

SEQ ID NO: 1260 - protein, 273 aa, Neisseria gonorrhoeae
MDFLIVLKALMMGLVEGFTEFLPISSTGHLIVFGNLIGFHSNHKVFEIAIQLGAVLAVVFEYRQRFSNVLHGVGKDRKANRFVLNLAIAFIPAAVMGLLFDKQIKEYLFNPLSVAVMLVLGGFFILWVEKRQSRAEPKIADVDALRPIDALMIGVAQVFALVPGTSRSGSTVMGGMLWGIERKTATEFSFFLAVPMMVAATAYDVLKHYRFFTLHDVGLILIGFIAAFVSGLVAVKALLKFVSKKNYIPFAYYRIVFGIVIIILWLSGWISWE

SEQ ID NO: 1261 - DNA, 734 bp, Neisseria meningitidis
atggattttctgattgtcctgaaagccctgatgatgggcttggtagaaggttttaccgaatttttaccgatttccagcaccggacatttgattgtgttcggcaatctgattggttttcacagcaatcacaaggtttttgaaattgccatccagctcggtgcagttttggcggtagtgtttgaataccggcaacgtttcagcaatgtgttgcacggcttgggaaaagaccggaaagccaaccgcttcgtccttaatcttgccattgcttttatacctgccgccgtgatggggctgttgttcggcawacaaatcaaagagyatctgtttaaccccttgagtgttgcagtcatgctggttytggrcggtttttytattttgtgggtggagaaacgccaaagccgagcagagcctaaaattgccgatgttgatgcattgcgtccgattgatgccttgatgatcggcgttgcccaagtgtttgcactggttccgggtacgtcccgttcgggcagtacgattatgggcgggatgctttggggcatcgaacggaaaactgcgacagaattctcgtttttcttggctgtgccgatgatggttgccgcaacggcttatgatgtcctgaaacattaccgatttttcaccctgcatgatgtcggtttgattctgataggctttattgctgcctttgtttcaggcttggtagcggtaaaagcgttgctgaggtttgtttcgggtac

SEQ ID NO: 1262 - protein, 244 aa, Neisseria meningitidis
  misc_feature (102)..(102): Xaa can be any naturally occurring amino acid
  misc_feature (107)..(107): Xaa can be any naturally occurring amino acid
  misc_feature (121)..(121): Xaa can be any naturally occurring amino acid
  misc_feature (124)..(124): Xaa can be any naturally occurring amino acid
MDFLIVLKALMMGLVEGFTEFLPISSTGHLIVFGNLIGFHSNHKVFEIAIQLGAVLAVVFEYRQRFSNVLHGLGKDRKANRFVLNLAIAFIPAAVMGLLFGXQIKEXLFNPLSVAVMLVLXGFXILWVEKRQSRAEPKIADVDALRPIDALMIGVAQVFALVPGTSRSGSTIMGGMLWGIERKTATEFSFFLAVPMMVAATAYDVLKHYRFFTLHDVGLILIGFIAAFVSGLVAVKALLRFVSG

SEQ ID NO: 1263 - DNA, 822 bp, Neisseria meningitidis
atggattttctgattgtcctgaaagccctgatgatgggcttggtagaaggttttaccgaatttttaccgatttccagcaccggacatttgattgtgttcggcaatctgattgattttcacagcaatcacaaggtttttgaaattaccatccagctcggtgcggttttggcggtagtgtttgaataccggcagcgtttcagcaatgtgttgcatggcgtgggaaaagaccggaaagccaaccgtttcgtccttaatcttgccattgcttttatacctgccgccgtgatggggctgttgttcggcaaacaaatcaaagagtatctgtttaaccccttgagtgttgcagtcatgctggttttgggcggtttttttattttgtgggtggagaaacgccaaagccgagcagagcctaaaattgtcgatgttgatgcattgcgtccgattgatgcgttgatgatcggcgttgcccaagtgtttgcactggttccaggtacgtcccgttcgggcagtacgattatgggcgggatgctttggggaatcgagcggaaaacggcaacggagttttcatttttcttggccgttccgatgatggttgcagcaacggcttatgatgtcctgaagcattaccggtttttcaccctgcatgatgtcggtttgattttgattggctttgttgctgcctttgtttcaggcttggtggcggtcaaagcgttgctgaggtttgtttccaagaaaaattatattccttttgcctattaccgcattgtttttggtattgccatcattatattgtggctgtcaggctggataagttgggaatga

SEQ ID NO: 1264 - protein, 273 aa, Neisseria meningitidis
MDFLIVLKALMMGLVEGFTEFLPISSTGHLIVFGNLIDFHSNHKVFEITIQLGAVLAVVFEYRQRFSNVLHGVGKDRKANRFVLNLAIAFIPAAVMGLLFGKQIKEYLFNPLSVAVMLVLGGFFILWVEKRQSRAEPKIVDVDALRPIDALMIGVAQVFALVPGTSRSGSTIMGGMLWGIERKTATEFSFFLAVPMMVAATAYDVLKHYRFFTLHDVGLILIGFVAAFVSGLVAVKALLRFVSKKNYIPFAYYRIVFGIAIIILWLSGWISWE

SEQ ID NO: 1265 - DNA, 804 bp, Neisseria gonorrhoeae
atgtttatgaacaaattttcccaatccggaaaaggtctgtccggtttcttcttcggtttgatactggcaacggtcattattgccggtattttgctttatctgaaccagggcggtcaaaatgcgttcaaaatcccggctccgtcgaagcagcctgcagaaacggaaatcctgaaactgaaaaaccagcctaaggaagacatccaacctgaaccggccgatcaaaacgccttgtccgaaccggatgttgcgaaagaggcagagcagtcggatgcggaaaaagctgccgacaagcagcccgttgccgacaaagccgacgaggttgaagaaaaggcgggcgagccggaacgggaagagccggacggacaggcagtgcgcaagaaagcactgactgaagagcgtgaacaaaccgtcagggaaaaagcgcagaagaaagatgccgaaacggttaaaaaaaaagcggtaaaaccgtctaaagaaacagagaaaaaagcttcaaaagaagagaaaaaggcggcgaaagaaaaagttgcacccaaaccgaccccggaacaaatcctcaacagccgcagtatcgaaaaagcgcgtagtgccgctgccaaagaagtgcagaaaatgaaaaactttgggcaaggcggaagccaacgcattatctgcaaatgggcgcgtatgccgaaccccggagcgcggaagggcagcgtgccaaactggcaatcttgggcatatcttccgaagtggtcggctatcaggcgggacataaaacgctttaccgcgtgcaaagcggcaatatgtccgccgatgcggtga

SEQ ID NO: 1266 - protein, 267 aa, Neisseria gonorrhoeae
MFMNKFSQSGKGLSGFFFGLILATVIIAGILLYLNQGGQNAFKIPAPSKQPAETEILKLKNQPKEDIQPEPADQNALSEPDVAKEAEQSDAEKAADKQPVADKADEVEEKAGEPEREEPDGQAVRKKALTEEREQTVREKAQKKDAETVKKKAVKPSKETEKKASKEEKKAAKEKVAPKPTPEQILNSRSIEKARSAAAKEVQKMKNFGQGGSQRIICKWARMPNPGARKGSVPNWQSWAYLPKWSAIRRDIKRFTACKAAICPPMR

SEQ ID NO: 1267 - DNA, 759 bp, Neisseria meningitidis
ggtttgttcttcggtttgatactggcgacggtcattattgccggtattttgttttatctgaaccagagcggtcaaaatgcgttcaaaatcccggcttcgtcgaagcagcctgcagaaacggaaatcctgaaaccgmawaaccagcytaaggaagacatccaacctgawccggccgatcaaaacgccttgtccgaaccggatgctgcgacagaggcagagcagtcggatgcggaaaawgctgccgacaagcagcccgttgccgataaagccgacgaggttgaagaaaaggcgggcgagccggaacgggaagagccggacggacaggcagtgcgtaagaaagcgctgacggaagagcgtgaacaaaccgtcagggaaaaagcgcagaagaaagatgccgaaacggttaaaawacaagcggtaaaaccgtctaaagaaacagagaaaaaagcttcaaaagaagagaaaaaggcggcgaaggaaaaagttgcacccaaaccaaccccggaacaaatcctcaacagcggcagcatcgaaaaagcgcgcagtgccgccgccaaagaagtgcagaaaatgaaaacgccgacaaggcggaagcaacgcattatctgcaaatgggcgcgtatgccgaccgtcagagcgcggaagggcagcgtgccaaactggcaatcttgggcatatcttccaaggtggtcggttatcaggcgggacataaaacgctttaccgggtgcaaagcggcaatatgtctgccgatgcggtga

SEQ ID NO: 1268 - protein, 252 aa, Neisseria meningitidis
  misc_feature (46)..(46): Xaa can be any naturally occurring amino acid
  misc_feature (49)..(49): Xaa can be any naturally occurring amino acid
  misc_feature (56)..(56): Xaa can be any naturally occurring amino acid
  misc_feature (79)..(79): Xaa can be any naturally occurring amino acid
  misc_feature (137)..(137): Xaa can be any naturally occurring amino acid
GLFFGLILATVIIAGILFYLNQSGQNAFKIPASSKQPAETEILKPXNQXKEDIQPXPADQNALSEPDAATEAEQSDAEXAADKQPVADKADEVEEKAGEPEREEPDGQAVRKKALTEEREQTVREKAQKKDAETVKXQAVKPSKETEKKASKEEKKAAKEKVAPKPTPEQILNSGSIEKARSAAAKEVQKMKTPTRRKQRIICKWARMPTVRARKGSVPNWQSWAYLPRWSVIRRDIKRFTGCKAAICLPMR

SEQ ID NO: 1269 - DNA, 801 bp, Neisseria meningitidis
atgtttatgaacaaattttcccaatccggaaaaggtctgtccggttttttcttcggtttgatactggcgacggtcattattgccggtattttgttttatctgaaccagagcggtcaaaatgcgttcaaaatcccggttccgtcgaagcagcctgcagaaacggaaatcctgaaaccgaaaaaccagcctaaggaagacatccaacctgaaccggccgatcaaaacgccttgtccgaaccggatgctgcgaaagaggcagagcagtcggatgcggaaaaagctgccgacaagcagcccgttgccgacaaagccgacgaggttgaggaaaaggcggacgagccggagcgggaaaagtcggacggacaggcagtgcgcaagaaagcactgacggaagagcgtgaacaaaccgtcggggaaaaagcgcagaagaaagatgccgaaacggttaaaaaacaagcggtaaaaccatctaaagaaacagagaaaaaagcttcaaaagaagagaaaaaggcggagaaggaaaaagttgcacccaaaccgaccccggaacaaatcctcaacagcggcagcatcgaaaaagcgcgcagtgccgctgccaaagaagtgcagaaaatgaaaacgccgacaaggcggaagcaacgcattatctgcaaatgggcgcgtatgccgaccgccggagcgcggaagggcagcgtgccaaactggcaatcttgggcatatcttccaaggtggtcggttatcaggcgggacataaaacgctttaccgggtgcaaagcggcaatatgtctgccgatgcggtga

SEQ ID NO: 1270 - protein, 266 aa, Neisseria meningitidis
MFMNKFSQSGKGLSGFFFGLILATVIIAGILFYLNQSGQNAFKIPVPSKQPAETEILKPKNQPKEDIQPEPADQNALSEPDAAKEAEQSDAEKAADKQPVADKADEVEEKADEPEREKSDGQAVRKKALTEEREQTVGEKAQKKDAETVKKQAVKPSKETEKKASKEEKKAEKEKVAPKPTPEQILNSGSIEKARSAAAKEVQKMKTPTRRKQRIICKWARMPTAGARKGSVPNWQSWAYLPRWSVIRRDIKRFTGCKAAICLPMR

SEQ ID NO: 1271 - DNA, 867 bp, Neisseria gonorrhoeae
atgaaaaccttcttcaaaaccctttcgaccgcgtcactcgcgctcatcctcgcagcctgcggcggtcaaaaagacagcgcgcccgcagcctctgccgccgccccttctgccgataacggcgcggcgaaaaaagaaatcgtcttcggcacgaccgtgggcgacttcggcgatatggtcaaagaacaaatccaagccgagctggagaaaaaaggctacaccgtcaaattggtcgaatttaccgactatgtgcgcccgaatctggcattggcggagggcgagttggacatcaacgtcttccaacacaaaccctatcttgacgatttcaaaaaagaacacaacctggacatcaccgaagccttccaagtgccgaccgcgcctttgggactgtatccgggcaaactgaaatcgctggaagaagtcaaagacggcagcaccgtatccgcgcccaacgacccgtccaacttcgcacgcgccttggtgatgctgaacgaactgggttggatcaaactcaaagacggcatcaatccgctgaccgcatccaaagccgacatcgcggaaaacctgaaaaacatcaaaatcgtcgagcttgaagccgcacaactgccgcgcagccgcgccgacgtggattttgccgtcgtcaacggcaactacgccataagcagcggcatgaagctgaccgaagccctgttccaagagccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaataccctgccgcatggaatgaaggcgcagccaaataa

SEQ ID NO: 1272 - protein, 288 aa, Neisseria gonorrhoeae
MKTFFKTLSTASLALILAACGGQKDSAPAASAAAPSADNGAAKKEIVFGTTVGDFGDMVKEQIQAELEKKGYTVKLVEFTDYVRPNLALAEGELDINVFQHKPYLDDFKKEHNLDITEAFQVPTAPLGLYPGKLKSLEEVKDGSTVSAPNDPSNFARALVMLNELGWIKLKDGINPLTASKADIAENLKNIKIVELEAAQLPRSRADVDFAVVNGNYAISSGMKLTEALFQEPSFAYVNWSAVKTADKDSQWLKDVTEAYNSDAFKAYAHKRFEGYKYPAAWNEGAAK

SEQ ID NO: 1273 - DNA, 117 bp, Neisseria meningitidis
caatggcttaaagacgtaaccgaggcctataactccgacgcgttcaaagcctacgcgcacaaacgcttcgagggctacaaatcccctgccgcatggaatgaaggcgcagccaaataa

SEQ ID NO: 1274 - protein, 38 aa, Neisseria meningitidis
QWLKDVTEAYNSDAFKAYAHKRFEGYKSPAAWNEGAAK

SEQ ID NO: 1275 - DNA, 864 bp, Neisseria meningitidis
  misc_feature (131)..(131): n is a, c, g, or t
  misc_feature (278)..(278): n is a, c, g, or t
  misc_feature (513)..(513): n is a, c, g, or t
  misc_feature (629)..(629): n is a, c, g, or t
  misc_feature (645)..(645): n is a, c, g, or t
atgaaaaccttcttcaaaaccctttccgccgccgcactcgcgctcatcctcgccgcctgcggcggtcaaaaagatagcgcgcccgccgcatccgcttctgccgccgccgacaacggcgcggcgaaaaaagnaatcgtcttcggcacgaccgtcggcgacttcggcgatatggtcaaagaacaaatccaacccgagctggagaaaaaaggctacaccgtcaaactggtcgagtttaccgactatgtgcgcccgaatctggcattggctgagggcgagtnggacatcaacgtcttccaacacaaaccctatcttgacgacttcaaaaaagaacacaatctggacatcaccgaagtcttccaagtgccgaccgcgcctttgggactgtacccgggcaagctgaaatcgctggaagaagtcaaagacggcagcaccgtatccgcgcccaacgacccgtccaacttcgcccgcgtcttggtgatgctcgacgaactgggttggatcaaactcaaaganggcatcaatccgctgaccgcatccaaagcggacattgccgaaaacctgaaaaacatcaaaatcgtcgagcttgaagccgcgcaactgccgcgtagccgcgccgacgtggattttgncgtcgtcaacggcaantacgccataagcagcggcatgaagctgaccgaagccctgttccaagaaccgagctttgcctatgtcaactggtctgccgtcaaaaccgccgacaaagacagccaatggcttaaagacgtaaccgaggcctataactccgacgcgttcaaagcctacgcgcacaaacgcttcgagggctacaaatcccctgccgcatggaatgaaggcgcagccaaataa

SEQ ID NO: 1276 - protein, 287 aa, Neisseria meningitidis
  misc_feature (44)..(44): Xaa can be any naturally occurring amino acid
  misc_feature (93)..(93): Xaa can be any naturally occurring amino acid
  misc_feature (171)..(171): Xaa can be any naturally occurring amino acid
  misc_feature (210)..(210): Xaa can be any naturally occurring amino acid
  misc_feature (215)..(215): Xaa can be any naturally occurring amino acid
MKTFFKTLSAAALALILAACGGQKDSAPAASASAAADNGAAKKXIVFGTTVGDFGDMVKEQIQPELEKKGYTVKLVEFTDYVRPNLALAEGEXDINVFQHKPYLDDFKKEHNLDITEVFQVPTAPLGLYPGKLKSLEEVKDGSTVSAPNDPSNFARVLVMLDELGWIKLKXGINPLTASKADIAENLKNIKIVELEAAQLPRSRADVDFXVVNGXYAISSGMKLTEALFQEPSFAYVNWSAVKTADKDSQWLKDVTEAYNSDAFKAYAHKRFEGYKSPAAWNEGAAK

SEQ ID NO: 1277 - DNA, 699 bp, Neisseria gonorrhoeae
atgttaaatcgggtattttatcggatattgggtgttgccgacaatttgtatccgtgtttatcggatttctgttttttcactataatagccggtttgccgttgcaggcggttttatgggaaaggcggatgatggtacggcgtttgataatcggcatcagcggggcgagcggtttccaatacggcgtgaaggctttggaacttttgcgcgcgcaagatgtcgaaacgcaccttgtggtatcgaaaggcgcggagatggcgcgcgcttcggaaacggattatacgaaagacgaagtatatgccttggctgatttcgtccatccgatcggcaatatcggggcgtgcattgccagcggtacgtttaaaacggacgggatgctggtcgcaccctgttcgatgcggacgcttgcctctgtcgcgcacggcttcggcgacaacctcttgacgcgtgcggcggatgtggttttgaaggaaaggcggcggctggtgctgatggtgcgcgaaacgccgctgaaccttgcccatttggacaatatgaagcgggtaacggaaatgggcggcgtggtgtttccccctgttcctgcgatgtaccgcaagccgcagacggcggacgacatagtggcgcacagtatcgcacacacgctgtcgctgttcggaatcgatacgccggatttggcggaatggcagggaatggcggattaa

SEQ ID NO: 1278 - protein, 232 aa, Neisseria gonorrhoeae
MLNRVFYRILGVADNLYPCLSDFCFFTIIAGLPLQAVLWERRMMVRRLIIGISGASGFQYGVKALELLRAQDVETHLVVSKGAEMARASETDYTKDEVYALADFVHPIGNIGACIASGTFKTDGMLVAPCSMRTLASVAHGFGDNLLTRAADVVLKERRRLVLMVRETPLNLAHLDNMKRVTEMGGVVFPPVPAMYRKPQTADDIVAHSIAHTLSLFGIDTPDLAEWQGMAD

SEQ ID NO: 1279 - DNA, 693 bp, Neisseria meningitidis
atgttaaatcgggtattttatcggatattgggtgttgccgacaatttgtatccgcgtttatcggatttctgttttttcactataatagccggtttgccgttgcaggcggttttatgggaaaggcggatgatggtacggcgtttgataatcggcatcagcggggcgagcggtttccaatacggcgtgaaggctttggaacttttgcgcgcgcaagatgtcgaaacgcaccttgtggtatcgaaaggtgcggagatggcgcgcgcttcggaaacggcttatgcgagagacgaggtatatgccttggcggacttcgtgcatccgatcggcaatatcggggcgtgcattgccagcggtacgtttaaaacggatgggatgctggtcgccccctgttcgatgcggacgcttgcctctgtcgcgcacggcttcggcgacaatctgctgacgcgtgcggcggatgtggttttgaaggaaaggcggcggctggtgctgatggtgcgcgaaacgccgctgaaccttgcccatttggacaatatgaagcgggwaacggaaatgggcggcgtggtgtttccccctgttcctgcgatgtaccgcaaaccgcagacggcggacgacatagtggcgcacagtgttgcacacgctttgtcgctgttcggaatcgatacgccggattcggcggaatggcarggaatggcg

SEQ ID NO: 1280 - protein, 231 aa, Neisseria meningitidis
  misc_feature (181)..(181): Xaa can be any naturally occurring amino acid
MLNRVFYRILGVADNLYPRLSDFCFFTIIAGLPLQAVLWERRMMVRRLIIGISGASGFQYGVKALELLRAQDVETHLVVSKGAEMARASETAYARDEVYALADFVHPIGNIGACIASGTFKTDGMLVAPCSMRTLASVAHGFGDNLLTRAADVVLKERRRLVLMVRETPLNLAHLDNMKRXTEMGGVVFPPVPAMYRKPQTADDIVAHSVAHALSLFGIDTPDSAEWQGMA

SEQ ID NO: 1281 - DNA, 699 bp, Neisseria meningitidis
  misc_feature (198)..(198): n is a, c, g, or t
  misc_feature (275)..(275): n is a, c, g, or t
  misc_feature (291)..(291): n is a, c, g, or t
  misc_feature (312)..(312): n is a, c, g, or t
  misc_feature (537)..(537): n is a, c, g, or t
atgttaaatcggatattttatcggatattgggtgttgccgacaatttgtatccgtatttatcggatttctgttttttcactataatagccggtttgccgttgcaggcggttttatgggaaaggcggatgatggtacggcgtttgataatcggcatcagtggggcgagcggtttccaatacggcgtgaaggctttggancttttacgcgcgcaagatatcgaaacgcaccttgtggtatcgaaaggtgcggagatggcgcgcgcttcggaaacggnttatgcgagagacgangtatatgccttggcggacttngtgcatccgatcggcaatatcggggcgtgcattgccagcggtacgtttaaaacggacgggatgctggtcgccccctgttcgatgcggacgcttgcctcggtcgtgcacggcttcggcgacaacctcttgacgcgtgcggcggatgtggttttgaaggaaaggcggcggctggtgctgatggtgcgcgaaacgccgctgaaccttgcccatttggacaatatgaancgggtaacggaaatgggcggcgtggtgtttccccctgttcctgcgatgtaccgcaaaccgcagacggcggacgacatagtggcgcacagtgttgcacacgctttgtcgctgttcggaatcgatacgccggattcggcggaatggcagggaatggcggattaa

SEQ ID NO: 1282 - protein, 232 aa, Neisseria meningitidis
  misc_feature (66)..(66): Xaa can be any naturally occurring amino acid
  misc_feature (92)..(92): Xaa can be any naturally occurring amino acid
  misc_feature (97)..(97): Xaa can be any naturally occurring amino acid
  misc_feature (104)..(104): Xaa can be any naturally occurring amino acid
  misc_feature (179)..(179): Xaa can be any naturally occurring amino acid
MLNRIFYRILGVADNLYPYLSDFCFFTIIAGLPLQAVLWERRMMVRRLIIGISGASGFQYGVKALXLLRAQDIETHLVVSKGAEMARASETXYARDXVYALADXVHPIGNIGACIASGTFKTDGMLVAPCSMRTLASVVHGFGDNLLTRAADVVLKERRRLVLMVRETPLNLAHLDNMXRVTEMGGVVFPPVPAMYRKPQTADDIVAHSVAHALSLFGIDTPDSAEWQGMAD

SEQ ID NO: 1283 - DNA, 699 bp, Neisseria gonorrhoeae; identical to SEQ ID NO: 1277

SEQ ID NO: 1284 - protein, 232 aa, Neisseria gonorrhoeae; identical to SEQ ID NO: 1278

SEQ ID NO: 1285 - DNA, 699 bp, Neisseria meningitidis
atgttaaatcgggtattttatcggatattgggtgttgccgacaatttgtatccgcgtttatcggatttctgttttttcactataatagccggtttgccgttgcaggcggttttatgggaaaggcggatgatggtacggcgtttgataatcggcatcagcggggcgagcggtttccaatacggcgtgaaggctttggaacttttgcgcgcgcaagatgtcgaaacgcaccttgtggtatcgaaaggtgcggagatggcgcgcgcttcggaaacggcttatgcgagagacgaggtatatgccttggcggacttcgtgcatccgatcggcaatatcggggcgtgcattgccagcggtacgtttaaaacggatgggatgctggtcgccccctgttcgatgcggacgcttgcctctgtcgcgcacggcttcggcgacaatctgctgacgcgtgcggcggatgtggttttgaaggaaaggcggcggctggtgctgatggtgcgcgaaacgccgctgaaccttgcccatttggacaatatgaagcgggtaacggaaatgggcggcgtggtgtttccccctgttcctgcgatgtaccgcaaaccgcagacggcggacgacatagtggcgcacagtgttgcacacgctttgtcgctgttcggaatcgatacgccggattcggcggaatggcagggaatggcggattaa

SEQ ID NO: 1286 - protein, 232 aa, Neisseria meningitidis
MLNRVFYRILGVADNLYPRLSDFCFFTIIAGLPLQAVLWERRMMVRRLIIGISGASGFQYGVKALELLRAQDVETHLVVSKGAEMARASETAYARDEVYALADFVHPIGNIGACIASGTFKTDGMLVAPCSMRTLASVAHGFGDNLLTRAADVVLKERRRLVLMVRETPLNLAHLDNMKRVTEMGGVVFPPVPAMYRKPQTADDIVAHSVAHALSLFGIDTPDSAEWQGMAD

SEQ ID NO: 1287 - DNA, 699 bp, Neisseria meningitidis; identical to SEQ ID NO: 1281
  misc_feature (198)..(198): n is a, c, g, or t
  misc_feature (275)..(275): n is a, c, g, or t
  misc_feature (291)..(291): n is a, c, g, or t
  misc_feature (312)..(312): n is a, c, g, or t
  misc_feature (537)..(537): n is a, c, g, or t

SEQ ID NO: 1288 - protein, 232 aa, Neisseria meningitidis; identical to SEQ ID NO: 1282
  misc_feature (66)..(66): Xaa can be any naturally occurring amino acid
  misc_feature (92)..(92): Xaa can be any naturally occurring amino acid
  misc_feature (97)..(97): Xaa can be any naturally occurring amino acid
  misc_feature (104)..(104): Xaa can be any naturally occurring amino acid
  misc_feature (179)..(179): Xaa can be any naturally occurring amino acid

SEQ ID NO: 1289 - DNA, 1368 bp, Neisseria gonorrhoeae
atgttcagtttcggctgggcgtttgaccgcccgcagtatgagttgggttcgctgtcgcctgttgcggcacttgcgtgccggcgcgctttggggtgtttgggtttggaaacgcaaatcaagtggccaaacgatttggtcgtcggacgcgacaaattgggcggcattctgattgaaacagtcagggcgggcggtaaaacggttgccgtggtcggtatcggcatcaatttcgtgctgcccaaggaagtggaaaacgccgcttccgtgcagtcgctgtttcagacggcatcgcggcggggcaatgccgatgccgccgtattgctggaaacattgcttgcggaactgggcgcggtgttggaacaatatgcggaagaagggttcgcgccatttttaaatgagtatgaaacggccaaccgcgaccacggcaaggcggtattgctgttgcgcgacggcgaaaccgtgtgcgaaggcacggttaaaggcgtggacggacgaggcgttctgcacttggaaacggcagaaggcgaacagacggtcgtcagcggcgaaatcagcctgcggcccgacaacaggtcggtttccgtgccgaagcggccggattcggaacgttttttgctgttggaaggcgggaacagccggctcaagtgggcgtgggtggaaaacggcacgttcgcaaccgtgggcagcgcgccgtaccgcgatttgtcgcctttgggcgcggagtgggcggaaaaggcggatggaaatgtccgcatcgtcggttgcgccgtgtgcggagaatccaaaaaggcacaagtgaaggaacagctcgcccgaaaaatcgagtggctgccgtcttccgcacaggctttgggcatacgcaaccactaccgccaccccgaagaacacggttccgaccgttggttcaacgccttgggcagccgccgcttcagccgcaacgcctgcgtcgtcgtcagttgcggcacggcggtaacggttgacgcgctcaccgatgacggacattatctcggcggaaccatcatgcccggcttccacctgatgaaagaatcgctcgccgtccgaaccgccaacctcaaccgccccgccggcaaacgttaccctttcccgaccacaacgggcaacgccgtcgcaagcggcatgatggacgcggtttgcggctcgataatgatgatgcacggccgtttgaaagaaaaaaacggcgcgggcaagcctgtcgatgtcatcattaccggcggcggcgcggcgaaagtcgccgaagccctgccgcctgcatttttggcggaaaataccgtgcgcgtggcggacaacctcgtcatccacgggctgctgaacctgattgccgccgaaggcggggaatcggaacacgcttaa

SEQ ID NO: 1290 - protein, 455 aa, Neisseria gonorrhoeae
MFSFGWAFDRPQYELGSLSPVAALACRRALGCLGLETQIKWPNDLVVGRDKLGGILIETVRAGGKTVAVVGIGINFVLPKEVENAASVQSLFQTASRRGNADAAVLLETLLAELGAVLEQYAEEGFAPFLNEYETANRDHGKAVLLLRDGETVCEGTVKGVDGRGVLHLETAEGEQTVVSGEISLRPDNRSVSVPKRPDSERFLLLEGGNSRLKWAWVENGTFATVGSAPYRDLSPLGAEWAEKADGNVRIVGCAVCGESKKAQVKEQLARKIEWLPSSAQALGIRNHYRHPEEHGSDRWFNALGSRRFSRNACVVVSCGTAVTVDALTDDGHYLGGTIMPGFHLMKESLAVRTANLNRPAGKRYPFPTTTGNAVASGMMDAVCGSIMMMHGRLKEKNGAGKPVDVIITGGGAAKVAEALPPAFLAENTVRVADNLVIHGLLNLIAAEGGESEHA

SEQ ID NO: 1291 - DNA, 1167 bp, Neisseria meningitidis
  misc_feature (240)..(240): n is a, c, g, or t
  misc_feature (321)..(344): n is a, c, g, or t
  misc_feature (367)..(367): n is a, c, g, or t
  misc_feature (385)..(385): n is a, c, g, or t
atgttcagttttggctgggtgtttgaccggccgcagtatgagttgggttcgctgtcgcctgttgcggcagtggcgtgtcggcgcgccttgtcgcgtttaggtttggatgtgcarattaagtggcccaatgatttggttgtcggacgcgacaaattgggcggcattctgattgaaacggtcaggacgggcggcaaaacggttgccgtggtcggtatcggcatcaattttgtcctgcccaangaagtagaaaatgccgcttccgtgcaatcgctgtttcagacggcatcgcggcggggcaatgccgatgccgccgtgctgctnnnnnnnnnnnnnnnnnnnnnnnnggaaatcagcctgcggtccgacnacaggccggtttccgtgncgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggcggatggaaatgtccgcatcgtcggttgcgctgtgtgcggagaattcaaaaaggcacaagtgcaggaacagctcgcccgaaaaatcgagtggctgccgtcttccgcacaggctttgtttggcatacgcaaccactaccgccaccccgaagaacacggttccgaccgctggttcaacgccttgggcagccgccgcttcagccgcaacgcytgcgtcgtcgtcagttgcggcacggcggtaacggttgacgcgctcaccgatgacggacattatctcggrggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcatttacgggttgttgaacatgattgccgccgaaggcagggaatatgaacat

SEQ ID NO: 1292 - protein, 389 aa, Neisseria meningitidis
  misc_feature (80)..(80): Xaa can be any naturally occurring amino acid
  misc_feature (108)..(115): Xaa can be any naturally occurring amino acid
  misc_feature (123)..(123): Xaa can be any naturally occurring amino acid
  misc_feature (129)..(129): Xaa can be any naturally occurring amino acid
MFSFGWVFDRPQYELGSLSPVAAVACRRALSRLGLDVQIKWPNDLVVGRDKLGGILIETVRTGGKTVAVVGIGINFVLPXEVENAASVQSLFQTASRRGNADAAVLLXXXXXXXXEISLRSDXRPVSVXKRRDSERFLLLDGGNSRLKWAWVENGTFATVGSAPYRDLSPLGAEWAEKADGNVRIVGCAVCGEFKKAQVQEQLARKIEWLPSSAQALFGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIYGLLNMIAAEGREYEH

SEQ ID NO: 1293 - DNA, 1368 bp, Neisseria meningitidis
atgttcagttttggctgggtgtttgaccggccgcagtatgagttgggttcgctgtcgcctgttgcggcagtggcgtgccggcgcgccttgtcgcgtttgggtttgaaaacgcaaatcaagtggccaaacgatttggtcgtcggacgcgacaaattgggcggcattctgattgaaacggtcaggacgggcggcaaaacggttgccgtggtcggtatcggcatcaatttcgtgctgcccaaggaagtggaaaacgccgcttccgtgcaatcgctgtttcagacggcatcgcggcggggaaatgccgatgccgccgtgttgctggaaacgctgttggcggaacttgatgcggtgttgttgcaatatgcgcgggacggatttgcgccttttgtggcggaatatcaggctgccaaccgcgaccacggcaaggcggtattgctgttgcgcgacggcgaaaccgtgttcgaaggcacggttaaaggcgtggacggacaaggcgttctgcacttggaaacggcagagggcaaacagacggtcgtcagcggcgaaatcagcctgcggtccgacgacaggccggtttccgtgccgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggtggatggaaatgtccgcatcgtcggttgcgccgtgtgcggagaattcaaaaaggcacaagtgcaggaacagctcgcccgaaaaatcgagtggctgccgtcttccgcacaggctttgggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcgggggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcattcacgggctgctgaacctgattgccgccgaaggcggggaatcggaacatacttaa

SEQ ID NO: 1294 - protein, 455 aa, Neisseria meningitidis
MFSFGWVFDRPQYELGSLSPVAAVACRRALSRLGLKTQIKWPNDLVVGRDKLGGILIETVRTGGKTVAVVGIGINFVLPKEVENAASVQSLFQTASRRGNADAAVLLETLLAELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKVDGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIHGLLNLIAAEGGESEHT

SEQ ID NO: 1295 - DNA, 1779 bp, Neisseria gonorrhoeae
atgacggttttgaagccttcgcattggcgggtgttggcggagcttgccgacggtttgccgcaacacgtatcgcaattggcgcgtgaggcggacatgaagccgcagcagctcaacggtttttggcagcagatgccggcgcatatacgcgggctgttgcgccaacacgacggctattggcggctggtgcgccccttggcggttttcgatgccgaaggtttgcgcgatctgggggaaaggtcgggttttcagacggcattgaagcacgagtgcgcgtccagcaacgacgagatactggaattggcgcggattgcgccggacaaggcgcacaaaaccatatgcgtgacccacctgcaaagtaagggcagggggcggcaggggcggaagtggtcgcaccgtttgggcgagtgcctgatgttcagtttcggctgggcgtttgaccggccgcagtatgagttgggttcgctgtcgcctgttgcggcacttgcgtgccggcgcgctttggggtgtttgggtttggaaacgcaaatcaagtggccaaacgatttggtcgtcggacgcgacaaattgggcggcattctgattgaaacagtcagggcgggcggtaaaacggttgccgtggtcggtatcggcatcaatttcgtgctgcccaaggaagtggaaaacgccgcttccgtgcagtcgctgtttcagacggcatcgcggcggggcaatgccgatgccgccgtattgctggaaacattgcttgcggaactgggcgcggtgttggaacaatatgcggaagaagggttcgcgccatttttaaatgagtatgaaacggccaaccgcgaccacggcaaggcggtattgctgttgcgcgacggcgaaaccgtgtgcgaaggcacggttaaaggcgtggacggacgaggcgttctgcacttggaaacggcagaaggcgaacagacggtcgtcagcggcgaaatcagcctgcggcccgacaacaggtcggtttccgtgccgaagcggccggattcggaacgttttttgctgttggaaggcgggaacagccggctcaagtgggcgtgggtggaaaacggcacgttcgcaaccgtgggcagcgcgccgtaccgcgatttgtcgcctttgggcgcggagtgggcggaaaaggcggatggaaatgtccgcatcgtcggttgcgccgtgtgcggagaatccaaaaaggcacaagtgaaggaacagctcgcccgaaaaatcgagtggctgccgtcttccgcacaggctttgggcatacgcaaccactaccgccaccccgaagaacacggttccgaccgttggttcaacgccttgggcagccgccgcttcagccgcaacgcctgcgtcgtcgtcagttgcggcacggcggtaacggttgacgcgctcaccgatgacggacattatctcggcggaaccatcatgcccggcttccacctgatgaaagaatcgctcgccgtccgaaccgccaacctcaaccgccccgccggcaaacgttaccctttcccgaccacaacgggcaacgccgtcgcaagcggcatgatggacgcggtttgcggctcgataatgatgatgcacggccgtttgaaagaaaaaaacggcgcgggcaagcctgtcgatgtcatcattaccggcggcggcgcggcgaaagtcgccgaagccctgccgcctgcatttttggcggaaaataccgtgcgcgtggcggacaacctcgtcatccacgggctgctgaacctgattgccgccgaaggcggggaatcggaacacgcttaa

SEQ ID NO: 1296 - protein, 592 aa, Neisseria gonorrhoeae
MTVLKPSHWRVLAELADGLPQHVSQLAREADMKPQQLNGFWQQMPAHIRGLLRQHDGYWRLVRPLAVFDAEGLRDLGERSGFQTALKHECASSNDEILELARIAPDKAHKTICVTHLQSKGRGRQGRKWSHRLGECLMFSFGWAFDRPQYELGSLSPVAALACRRALGCLGLETQIKWPNDLVVGRDKLGGILIETVRAGGKTVAVVGIGINFVLPKEVENAASVQSLFQTASRRGNADAAVLLETLLAELGAVLEQYAEEGFAPFLNEYETANRDHGKAVLLLRDGETVCEGTVKGVDGRGVLHLETAEGEQTVVSGEISLRPDNRSVSVPKRPDSERFLLLEGGNSRLKWAWVENGTFATVGSAPYRDLSPLGAEWAEKADGNVRIVGCAVCGESKKAQVKEQLARKIEWLPSSAQALGIRNHYRHPEEHGSDRWFNALGSRRFSRNACVVVSCGTAVTVDALTDDGHYLGGTIMPGFHLMKESLAVRTANLNRPAGKRYPFPTTTGNAVASGMMDAVCGSIMMMHGRLKEKNGAGKPVDVIITGGGAAKVAEALPPAFLAENTVRVADNLVIHGLLNLIAAEGGESEHA

SEQ ID NO: 1297 - DNA, 1779 bp, Neisseria meningitidis
atgacggttttgaagctttcgcactggcgggtgttggcggagcttgccgacggtttgccgcaacacgtctcgcaactggcgcgtatggcggatatgaagccgcagcagctcaacggtttttggcagcagatgccggcgcacatacgcgggctgttgcgccaacacgacggctattggcggctggtgcgcccattggcggttttcgatgccgaaggtttgcgcgagctgggggaaaggtcgggttttcagacggcattgaagcacgagtgcgcgtccagcaacgacgagatactggaattggcgcggattgcgccggacaaggcgcacaaaaccatatgcgtgacccacctgcaaagtaagggcagggggcggcaggggcggaagtggtcgcaccgtttgggcgagtgtctgatgttcagttttggctgggtgtttgaccggccgcagtatgagttgggttcgctgtcgcctgttgcggcagtggcgtgtcggcgcgccttgtcgcgtttaggtttggatgtgcagattaagtggcccaatgatttggttgtcggacgcgacaaattgggcggcattctgattgaaacggtcaggacgggcggcaaaacggttgccgtggtcggtatcggcatcaattttgtcctgcccaaggaagtagaaaatgccgcttccgtgcaatcgctgtttcagacggcatcgcggcggggcaatgccgatgccgccgtgctgctggaaacgctgttggtggaactggacgcggtgttgttgcaatatgcgcgggacggatttgcgccttttgtggcggaatatcaggctgccaaccgcgaccacggcaaggcggtattgctgttgcgcgacggcgaaaccgtgttcgaaggcacggttaaaggcgtggacggacaaggcgttttgcacttggaaacggcagagggcaaacagacggtcgtcagcggcgaaatcagcctgcggtccgacgacaggccggtttccgtgccgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggcggatggaaatgtccgcatcgtcggttgcgctgtgtgcggagaattcaaaaaggcacaagtgcaggaacagctcgcccgaaaaatcgagtggctgccgtcttccgcacaggctttgggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcgggggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcatttacgggttgttgaacatgattgccgccgaaggcagggaatatgaacatatttaa

SEQ ID NO: 1298 - protein, 592 aa, Neisseria meningitidis
MTVLKLSHWRVLAELADGLPQHVSQLARMADMKPQQLNGFWQQMPAHIRGLLRQHDGYWRLVRPLAVFDAEGLRELGERSGFQTALKHECASSNDEILELARIAPDKAHKTICVTHLQSKGRGRQGRKWSHRLGECLMFSFGWVFDRPQYELGSLSPVAAVACRRALSRLGLDVQIKWPNDLVVGRDKLGGILIETVRTGGKTVAVVGIGINFVLPKEVENAASVQSLFQTASRRGNADAAVLLETLLVELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKADGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIYGLLNMIAAEGREYEHI

SEQ ID NO: 1299 - DNA, 1779 bp, Neisseria meningitidis
atgacggttttgaagccttcgcactggcgggtgttggcggagcttgccgacggtttgccgcaacacgtctcgcaactggcgcgtatggcggatatgaagccgcagcagctcaacggtttttggcagcagatgccggcgcacatacgcgggctgttgcgccaacacgacggctattggcggctggtgcgcccattggcggttttcgatgccgaaggtttgcgcgagctgggggaaaggtcgggttttcagacggcattgaagcacgagtgcgcgtccagcaacgacgagatactggaattggcgcggattgcgccggacaaggcgcacaaaaccatatgtgtgacccacctgcaaagtaagggcagggggcggcaggggcggaagtggtcgcaccgtttgggcgagtgtctgatgttcagttttggctgggtgtttgaccggccgcagtatgagttgggttcgctgtcgcctgttgcggcagtggcgtgccggcgcgccttgtcgcgtttgggtttgaaaacgcaaatcaagtggccaaacgatttggtcgtcggacgcgacaaattgggcggcattctgattgaaacggtcaggacgggcggcaaaacggttgccgtggtcggtatcggcatcaatttcgtgctgcccaaggaagtggaaaacgccgcttccgtgcaatcgctgtttcagacggcatcgcggcggggaaatgccgatgccgccgtgttgctggaaacgctgttggcggaacttgatgcggtgttgttgcaatatgcgcgggacggatttgcgccttttgtggcggaatatcaggctgccaaccgcgaccacggcaaggcggtattgctgttgcgcgacggcgaaaccgtgttcgaaggcacggttaaaggcgtggacggacaaggcgttctgcacttggaaacggcagagggcaaacagacggtcgtcagcggcgaaatcagcctgcggtccgacgacaggccggtttccgtgccgaagcggcgggattcggaacgttttctgctgttggacggcggcaacagccggctcaagtgggcgtgggtggaaaacggcacgttcgcaaccgtcggtagcgcgccgtaccgcgatttgtcgcctttgggcgcggagtgggcggaaaaggtggatggaaatgtccgcatcgtcggttgcgccgtgtgcggagaattcaaaaaggcacaagtgcaggaacagctcgcccgaaaaatcgagtggctgccgtcttccgcacaggctttgggcatacgcaaccactaccgccaccccgaagaacacggttccgaccgctggttcaacgccttgggcagccgccgcttcagccgcaacgcctgcgtcgtcgtcagttgcggcacggcggtaacggttgacgcgctcaccgatgacggacattatctcgggggaaccatcatgcccggtttccacctgatgaaagaatcgctcgccgtccgaaccgccaacctcaaccggcacgccggtaagcgttatcctttcccgaccacaacgggcaatgccgtcgccagcggcatgatggatgcggtttgcggctcggttatgatgatgcacgggcgtttgaaagaaaaaaccggggcgggcaagcctgtcgatgtcatcattaccggcggcggcgcggcaaaagttgccgaagccctgccgcctgcatttttggcggaaaataccgtgcgcgtggcggacaacctcgtcattcacgggctgctgaacctgattgccgccgaaggcggggaatcggaacatacttaa

SEQ ID NO: 1300 - protein, 592 aa, Neisseria meningitidis
MTVLKPSHWRVLAELADGLPQHVSQLARMADMKPQQLNGFWQQMPAHIRGLLRQHDGYWRLVRPLAVFDAEGLRELGERSGFQTALKHECASSNDEILELARIAPDKAHKTICVTHLQSKGRGRQGRKWSHRLGECLMFSFGWVFDRPQYELGSLSPVAAVACRRALSRLGLKTQIKWPNDLVVGRDKLGGILIETVRTGGKTVAVVGIGINFVLPKEVENAASVQSLFQTASRRGNADAAVLLETLLAELDAVLLQYARDGFAPFVAEYQAANRDHGKAVLLLRDGETVFEGTVKGVDGQGVLHLETAEGKQTVVSGEISLRSDDRPVSVPKRRDSERFLLLDGGNSRLKWAWVENGTFATVGSAPYRDLSPLGAEWAEKVDGNVRIVGCAVCGEFKKAQVQEQLARKIEWLPSSAQALGIRNHYRHPEEHGSDRWFNALGSRRFSRNACVVVSCGTAVTVDALTDDGHYLGGTIMPGFHLMKESLAVRTANLNRHAGKRYPFPTTTGNAVASGMMDAVCGSVMMMHGRLKEKTGAGKPVDVIITGGGAAKVAEALPPAFLAENTVRVADNLVIHGLLNLIAAEGGESEHT

SEQ ID NO: 1301 - DNA, 1356 bp, Neisseria gonorrhoeae
atgagtatccaatccggcgaaattttagaaaccgtcaaaatggttgccgaccggaattttgatgtccgcaccattaccatcggcattgatttgcacgactgcatcagcaccgacatcgacgtgttaaaccaaaacatttacaacaaaatcaccacggtcggcaaagacttggtggcaacggcgaaacacctttccgccaaatacggcgtgccgattgtgaatcagcgcatttccgttacgccgattgcccaaatcgcggcggcgaccaaagccgacagttatgtcagcgtggcgcagactttggacaaggcagccaaagccatcggcgtgtcctttatcggcggcttttccgcgctggtgcaaaaaggtatgtcgccttcggatgaggtgttgatccgttccgttcccgaagcgatgaaaactaccgatatcgtgtgcagctccatcaatatcggcagcacgcgtgccggtatcaatatggatgcggtcaagctggcaggcgaaaccatcaaacgcacggctgaaatcacacccgaaggtttcggctgcgccaaaatcgtcgtgttctgcaacgcggtggaagacaatccgtttatggcgggtgcgttccacggctcgggcgaagcggatgctgtgattaatgtcggcgtatccggtccaggcgtggtcaaagccgcgctggaaaattcggacgcggtcagcctgaccgaggtcgccgaagtcgtgaagaaaaccgctttcaaaatcacccgcgtgggcgaactcatcggtcgcgaagcctcaaaaatgctgaatatcccgttcggcattctcgatttgtcgctggcaccgacccccgccgtcggcgactcggtggcgcgcattcttgaagaaatgggcttgagcgtctgcggtacgcacggcacaacagcagctttggcattgctgaacgatgccgtgaaaaagggcggcatgatggcttccagcgcggtcggcggtttgagcggcgcgtttatccccgtttccgaagacgaaggtatgattgccgccgccgaggcaggcgtgttgacgctggacaaactcgaagccatgaccgccgtctgctccgttggtttggacatgattgccgttcccggcgacacgcccgcgcacaccatttccggcatcatcgccgacgaagccgccatcggcatgatcaacagcaaaaccaccgccgtgcgcattattccggtaacgggcaaaaccgtcggcgacagcgtcgagttcggcggtctgttgggctacgcgcctgtaatgccggcaaaagaaggttcgtgcgaagtgttcgtcaaccggggcggcaggattcccgcaccggttcaatcgatgaaaaactga

SEQ ID NO: 1302 - protein, 451 aa, Neisseria gonorrhoeae
MSIQSGEILETVKMVADRNFDVRTITIGIDLHDCISTDIDVLNQNIYNKITTVGKDLVATAKHLSAKYGVPIVNQRISVTPIAQIAAATKADSYVSVAQTLDKAAKAIGVSFIGGFSALVQKGMSPSDEVLIRSVPEAMKTTDIVCSSINIGSTRAGINMDAVKLAGETIKRTAEITPEGFGCAKIVVFCNAVEDNPFMAGAFHGSGEADAVINVGVSGPGVVKAALENSDAVSLTEVAEVVKKTAFKITRVGELIGREASKMLNIPFGILDLSLAPTPAVGDSVARILEEMGLSVCGTHGTTAALALLNDAVKKGGMMASSAVGGLSGAFIPVSEDEGMIAAAEAGVLTLDKLEAMTAVCSVGLDMIAVPGDTPAHTISGIIADEAAIGMINSKTTAVRIIPVTGKTVGDSVEFGGLLGYAPVMPAKEGSCEVFVNRGGRIPAPVQSMKN

SEQ ID NO: 1303 - DNA, 1344 bp, Neisseria meningitidis
atgagtatccaatccggcgaaattttagaaaccgtcaaaatggttgccgaccagaattttgatgtccgcaccattaccatcggcattgatttgcacgactgcatcagcagcgatatcaatgtgttgaaccaaaatatttacaataaaattaccacagtcggcaaagacttggtcactacggcaaaatatctgtctgccaaatacggcgtaccgattgtgaatcagcgcatttccgttacgccgattgcccaaatcgcggcggccacccatgctgattcttacgtcagcgtggcgcaaactttggataaagctgccaaagccatcggtgtgtcttttatcggcggtttttccgcgttggtgcaaaaagggatgtcgccttcggatgaggtgttaatccgctccattcccgaagcgatgaagactaccgatattgtgtgcwgctccatcaatatcggcagtacgcgtgccggtatcaatatggatgcggtcaagctggcgggcgaaaccgtcaaacgcacggcggaaatcacgcccgaaggtttcggctgcgctaaaattgtcgtgttctgcaacgcggtggaagacaacccgtttwtggcgggcgcgtttcatggttcgggcgatgccgttatcaatgtcggcgtatccggcccaggtgtcgtaaaagccgcgttggaaaattcagatgcaacgacattgaccgaagttgcggaagtagtgaagaaaactgctttcaaaattacccgcgtgggcgaactcatcggccgcgaagcctcaaaaatgctgaatatcccgtttggtattctcgacttgtcgccgaccccgcccgtcggcgactcagtggcacgcattcttgaagaaatgggcttgagcgtctgcggtacgcacggcacaacagcagctttggcattgctgaacgatgccgtgaaaaaaggcggcatgatggcttccagcgcggtcgggggtttgagtggcgcgtttatccccgtttccgaagacgaaggtatgatygmcgccgccgaagcaggcgtgctgacgctggacaaactcgaagccatgaccgccgtttgttcggtcggcttggatatgattgccgttcccggcgacacgcccgcgcacaccatttccggcatcattgccgacgaagccgccatcggcatgatcaacagcaaaaccactgccgtgcgcattattccggtaaccggtaaaaccgtcggcgacacggtcgagttcggcggcttgttgggctacgcgcctgtgatgccggtcaaagaaggttcgtgcgaagtattcgtcaaccgaggcggcagaattccggctccggttcaatcgatgaaaaactga

SEQ ID NO: 1304 - protein, 447 aa, Neisseria meningitidis
  misc_feature (147)..(147): Xaa can be any naturally occurring amino acid
  misc_feature (199)..(199): Xaa can be any naturally occurring amino acid
  misc_feature (338)..(338): Xaa can be any naturally occurring amino acid
MSIQSGEILETVKMVADQNFDVRTITIGIDLHDCISSDINVLNQNIYNKITTVGKDLVTTAKYLSAKYGVPIVNQRISVTPIAQIAAATHADSYVSVAQTLDKAAKAIGVSFIGGFSALVQKGMSPSDEVLIRSIPEAMKTTDIVCXSINIGSTRAGINMDAVKLAGETVKRTAEITPEGFGCAKIVVFCNAVEDNPFXAGAFHGSGDAVINVGVSGPGVVKAALENSDATTLTEVAEVVKKTAFKITRVGELIGREASKMLNIPFGILDLSPTPPVGDSVARILEEMGLSVCGTHGTTAALALLNDAVKKGGMMASSAVGGLSGAFIPVSEDEGMIXAAEAGVLTLDKLEAMTAVCSVGLDMIAVPGDTPAHTISGIIADEAAIGMINSKTTAVRIIPVTGKTVGDTVEFGGLLGYAPVMPVKEGSCEVFVNRGGRIPAPVQSMKN

SEQ ID NO: 1305 - DNA, 1356 bp, Neisseria meningitidis
atgagtatccaatccggcgaaattttagaaaccgtcaaaatggttgccgaccagaatttcgatgtccgcaccattaccatcggcattgatttgcacgactgcatcagcaccgacatcgacgtgttgaaccaaaatatttacaacaaaattaccacggtcggcaaagacttggtggcgacagcaaaatatctgtctgccaaatacggcgtgccgattgtgaatcagcgcatttctgtcacgccgattgcccaaatcgcggcggccacccatgctgattcttacgtcagcgtggcgcaaactttggataaggctgccaaagccatcggcgtgtcttttattggcggcttttccgcgctggtgcaaaaaggtatgtcgccttctgacgaggtgttaatccgttccattcccgaagcgatgaagactactgatatcgtgtgcagctccatcaatatcggcagtacgcgcgccggtatcaatatggacgcggtcagactggcgggcgaaaccatcaaacgcacggctgaaatcacactagaaggtttcggctgcgccaaaatcgtcgtgttctgcaacgcggtggaagacaacccgtttatggcgggcgcgtttcacggctcaggcgaagcggatgctgtgattaatgtcggcgtatccggcccgggtgtcgtaaaagccgcgttggaaaattcggatgcaacgacattgaccgaagttgccgaagttgtgaagaaaaccgccttcaaaattacccgcgtgggcgaactcatcggccgcgaagcctcaaaaatgctgaatatcccgtttggtattctcgacttgtcgctggcaccgacccctgccgtcggcgactcggtggcgcgcattcttgaagaaatgggtttgagcgtctgcggtacgcacggcacaacagcagctttggcattgctgaacgatgccgtgaaaaagggcggcatgatggcttcgagcgcggttggcggtttgagtggcgcgtttatccccgtttccgaagacgaaggtatgattgccgccgccgaagcaggcgtgctgacgttggataaactcgaagcgatgaccgccgtttgttcggtcggcttggatatgattgccgttcccggcgacacacccgcgcacaccatttccggcatcattgccgacgaagccgccatcggcatgatcaacagcaaaaccactgccgtgcgcattattccggtaaccggtaaaaccgtcggcgacagcgtcgagttcggcggcctgttgggctacgcgcctgtaatgccggtaaaagaaggctcatgcgaagtgttcgtcaaccggggcggcaggattcccgcaccggttcaatcgatgaaaaactga

SEQ ID NO: 1306 - protein, 451 aa, Neisseria meningitidis
MSIQSGEILETVKMVADQNFDVRTITIGIDLHDCISTDIDVLNQNIYNKITTVGKDLVATAKYLSAKYGVPIVNQRISVTPIAQIAAATHADSYVSVAQTLDKAAKAIGVSFIGGFSALVQKGMSPSDEVLIRSIPEAMKTTDIVCSSINIGSTRAGINMDAVRLAGETIKRTAEITLEGFGCAKIVVFCNAVEDNPFMAGAFHGSGEADAVINVGVSGPGVVKAALENSDATTLTEVAEVVKKTAFKITRVGELIGREASKMLNIPFGILDLSLAPTPAVGDSVARILEEMGLSVCGTHGTTAALALLNDAVKKGGMMASSAVGGLSGAFIPVSEDEGMIAAAEAGVLTLDKLEAMTAVCSVGLDMIAVPGDTPAHTISGIIADEAAIGMINSKTTAVRIIPVTGKTVGDSVEFGGLLGYAPVMPVKEGSCEVFVNRGGRIPAPVQSMKN

SEQ ID NO: 1307 - DNA, 522 bp, Neisseria gonorrhoeae
atggacgacccgcgcacctacggatcgggcaatcccggcgcgaccaatgttttacgcagcggcaaaaaaaaggcggccgcgctgacgctcttgggcgatgccgccaaaggtttggttgccgttttgcttgcacgcgtgcttcaagaaccgctcggtttatccgacagcgcaatcgccgccgtcgcactcgccgcgctggtcgggcatatgtggccggtgtttttcggatttaagggcggcaaaggcgtggcaacggcattgggcgtgcttctggcactctctcctgcaactgccttggtctgcgcgttgatttggcttgtgatggcattcggcttcaaagtatcctcccttgccgcgctggtcgccacaaccgccgccccccttgccgcactgttttttatgccgcatacttcttggattttcgcaaccctcgcaatcgccatattggtgttgctccgccataagagcaacatcctcaacctgattaaaggcaaagaaagcaaaatcggcgaaaaacgctga

SEQ ID NO: 1308 - protein, 173 aa, Neisseria meningitidis
MDDPRTYGSGNPGATNVLRSGKKKAAALTLLGDAAKGLVAVLLARVLQEPLGLSDSAIAAVALAALVGHMWPVFFGFKGGKGVATALGVLLALSPATALVCALIWLVMAFGFKVSSLAALVATTAAPLAALFFMPHTSWIFATLAIAILVLLRHKSNILNLIKGKESKIGEKR

SEQ ID NO: 1309 - DNA, 522 bp, Neisseria meningitidis
atggacgacccgcgcacctacggatcgggcaatccgggggcaaccaatgttttacgcagcggcaaaaaaaaggcggccgcgctgacgctcttgggcgatgccgccaaaggtttagttgccgttttgcttgcacgcgtgcttcaagaaccgctcggtttatccgacagcgcaatcgcggccgtcgcactcgccgcgctggtcgggcatatgtggccggtgtttttcggatttaaaggcggcaaaggcgtggcaacggcattgggcgtgcttctggcactctctcccgcaactgccttggtctgcgcgttgatttggcttgttatggcattcggcttcaaggtgtcctcccttgccgcattaaccgccacaatcgccgcaccggtcgccgcatccttctttatgccgcacgtctcgtgggtttgggcgaccgtcgccattgctttgctggtgttgttccgccacaaaagtaatatcgtcaagctgctcgaaggcagagaaagcaaaatcggcggcagccgctga

SEQ ID NO: 1310 - protein, 173 aa, Neisseria meningitidis
MDDPRTYGSGNPGATNVLRSGKKKAAALTLLGDAAKGLVAVLLARVLQEPLGLSDSAIAAVALAALVGHMWPVFFGFKGGKGVATALGVLLALSPATALVCALIWLVMAFGFKVSSLAALTATIAAPVAASFFMPHVSWVWATVAIALLVLFRHKSNIVKLLEGRESKIGGSR

SEQ ID NO: 1311 - DNA, 522 bp, Neisseria meningitidis
atggacgacccgcgcacctacggatcgggcaatccgggggcaaccaatgttttacgcagcggcaaaaaaaaggcggccgcgctgacgctcttgggcgatgccgccaaaggtttggttgccgttttgcttgcacgcgtgcttcaagaaccgctcggtttatccgacagcgcaatcgcggccgtcgcactcgccgcgctggtcgggcatatgtggccggtgtttttcggatttaaaggcggcaaaggcgtggcaacggcattgggcgtgcttctggcactctctcccacaactgccttggtctgcgcgttgatttggcttgtgatggcattcggcttcaaggtgtcctcccttgccgcattaaccgccacaatcgccgccccccttgccgcactgttttttatgccgcatacttcttggattttcgcaaccctcgcaatcgccatattggtgttgctccgccataagagcaacatcctcaacctgattaaaggcaaagaaagcaaaatcggcgaaaaacgctga

SEQ ID NO: 1312 - protein, 173 aa, Neisseria meningitidis
MDDPRTYGSGNPGATNVLRSGKKKAAALTLLGDAAKGLVAVLLARVLQEPLGLSDSAIAAVALAALVGHMWPVFFGFKGGKGVATALGVLLALSPTTALVCALIWLVMAFGFKVSSLAALTATIAAPLAALFFMPHTSWIFATLAIAILVLLRHKSNILNLIKGKESKIGEKR

SEQ ID NO: 1313 - DNA, 612 bp, Neisseria gonorrhoeae
atgaaattacaacaattggctgaagaaaaaatcggcgttctgattgtgttcacgctgcttgtagtcagtgtcggtctgttgattgaagttgtgcccttggcctttaccaaggcggcaacacagccggcgccgggcgtgaagccttacaatgccctgcaggttgccggacgcgatatttacatccgtgagggctgttacaactgccactctcaaatgattcgtccgttccgtgcggaaaccgagcgttacggtcattactctgttgccggagagtcggtttacgaccatccgttccaatggggttccaaacgtaccggtcctgatttggcacgtgtgggcggccgctattccgacgaatggcaccgcatccacctgctgaatccccgtgatgtcgtgcctgagtccaatatgccggcattcccgtggcttgcacgcaataaagtcgatgtcgatgcaaccgttgccaacatgaaggctttgcgtaaagtaggtactccttacagtgatgaggaaattgcgaaagcgcctgaggctttggcaaacaaatccgagctggatgctgtagtcgcctatctgcaaggattgggtctggctttgaaaaacgtaaggtaa

SEQ ID NO: 1314 - protein, 203 aa, Neisseria gonorrhoeae
MKLQQLAEEKIGVLIVFTLLVVSVGLLIEVVPLAFTKAATQPAPGVKPYNALQVAGRDIYIREGCYNCHSQMIRPFRAETERYGHYSVAGESVYDHPFQWGSKRTGPDLARVGGRYSDEWHRIHLLNPRDVVPESNMPAFPWLARNKVDVDATVANMKALRKVGTPYSDEEIAKAPEALANKSELDAVVAYLQGLGLALKNVR

SEQ ID NO: 1315 - DNA, 612 bp, Neisseria meningitidis
atgaaattacaacaattggctgaagaaaaaatcggcgttctgattgtgttcacgctgcttgtagtcagtgtcggtctgttgattgaagttgtgcccttggcctttaccaaggcggcaacacagccggcgccgggcgtgaagccttacaatgccctgcaggttgccggacgcgatatttacatccgtgagggctgttacaactgccactcgcaaatgattcgtccgttccgtgcggaaaccgagcgttacggtcattactctgttgccggagagtcggtttacgaccatccgttccaatggggttccaaacgtaccggtcctgatttggcacgtgtgggcggtcgctattccgacgaatggcaccgtatccacctgctgaatccccgtgatgtcgtgcctgagtccaatatgccggcattcccgtggcttgcacgcaataaagtcgatgtcgatgcaaccgttgccaacatgaaggctttgcgtaaagtaggtactccttacagtgatgaggaaattgcgaaagcacctgaggctttggcaaacaaatccgagctggatgctgtagtcgcctatctgcaaggattgggtctggctttgaaaaacgtaaggtaa

SEQ ID NO: 1316 - protein, 203 aa, Neisseria meningitidis; identical to SEQ ID NO: 1314

SEQ ID NO: 1317 - DNA, 612 bp, Neisseria meningitidis
atgaaattacaacaattggctgaagaaaaaatcggcgttctgattgtgttcacgctgcttgtagtcagtgtcggtctgttgattgaagttgtgcccttggcctttaccaaggcggcaacacagccggcgtcgggcgtgaagccttacaatgccctgcaggttgccggacgcgatatttacatccgtgagggctgttacaactgccactcgcaaatgattcgtccgttccgtgcggaaaccgagcgttacggtcattactctgttgccggagagtcggtttacgaccatccgttccaatggggttccaaacgtaccggtcctgatttggcacgtgtgggcggtcgctattccgacgaatggcaccgtatccacctgctgaatccccgtgatgtcgtgcctgagtccaatatgccggcattcccgtggcttgcacgcaataaagtcgatgtcgatgcaaccgttgccaacatgaaggctttgcgtaaagtaggtactccttacagtgatgaggaaattgcgaaagcgcctgaggctttggcaaacaaatccgagctggatgctgtagtcgcctatctgcaaggattgggtctggctttgaaaaacgtaaggtaa

SEQ ID NO: 1318 - protein, 203 aa, Neisseria meningitidis
MKLQQLAEEKIGVLIVFTLLVVSVGLLIEVVPLAFTKAATQPASGVKPYNALQVAGRDIYIREGCYNCHSQMIRPFRAETERYGHYSVAGESVYDHPFQWGSKRTGPDLARVGGRYSDEWHRIHLLNPRDVVPESNMPAFPWLARNKVDVDATVANMKALRKVGTPYSDEEIAKAPEALANKSELDAVVAYLQGLGLALKNVR

SEQ ID NO: 1319 - DNA, 1494 bp, Neisseria gonorrhoeae
atggatatggtgaacactaaaccgaatactagtgtgattaatatgctttctttccttaccggattattgagcttgggtatagaagtcttgtgggtaaggatgttttcgttcgcagcacagtccgtgcctcaggcattttcatttattcttgcctgttttctgaccggtatcgccgtcggcgcgtattttggcaaacggatttgccgcagccgctttgttgatattccctttatcgggcagtgcttcttgtgggcgggtattgccgattttttgattttgggtgctgcgtggttgttgacgggtttttccggtttcgtccaccacgccggtattttcattaccctgtctgccgtcgtcagggggttgattttcccacttgtacaccatgtgggtacggatggcaacaaatccggacgacaggtttccaatgtttatttcgccaacgttgccggcagtgcattgggtccggtccttatcggctttgtgatacttgatttgttgtccacccaacagatttacctgctcatctgtttgatttctgctgctgtccctttgttttgtacactgttccaaaaaagtctccgactgaatgcagtgtcggtagcagtttccctaatgttcggcatcctcatgttcctactgccggattctgtctttcaaaatattgctggccgtccggataggttgattgaaaacaaacacggcattgttgcggtttaccatagagatggtgataaggttgtttatggggcgaatgtatacgacggcgcatacaataccgatatattcaatagtgtcaacggcatcgaacgtgcctatctgctaccctccctgaagtccggcatacgccgcattttcgtcgttggattgagtacaggttcgtgggcgcgcgtcttgtctgccattccggaaatgcagtcgatgatcgttgcggaaatcaatccggcataccgtagccttatcgcggacgagccgcaaatcgcaccgcttttgcaggacaaacgtgttgaaattgtattggatgacggtaggaaatggctgcgtcgccatcctgatgaaaaattcgacctgattttgatgaattcgacttggtactggcgtgcctattccactaacctgttgagtgcggaatttttaaaacaggtgcaaagccaccttaccccggatggtattgtaatgtttaataccacgcacagcccgcatgcttttgctaccgccgtacacagtattccctatgcataccgctacgggcatatggtagtcggctcggcaaccccggtagttttccctaataaagaactgctcaagcaacgcctttcccggttgatttggccggaaagcggcaggcacgtatttgacagcagcaccgtggatgctgcagcacaaaaggttgtctctcgtatgctgattcggatgacggaaccttcggctggggcggaagtcattactgacgataatatgattgtagaatacaaatacggcagagggatttaa

SEQ ID NO: 1320 - protein, 497 aa, Neisseria gonorrhoeae
MDMVNTKPNTSVINMLSFLTGLLSLGIEVLWVRMFSFAAQSVPQAFSFILACFLTGIAVGAYFGKRICRSRFVDIPFIGQCFLWAGIADFLILGAAWLLTGFSGFVHHAGIFITLSAVVRGLIFPLVHHVGTDGNKSGRQVSNVYFANVAGSALGPVLIGFVILDLLSTQQIYLLICLISAAVPLFCTLFQKSLRLNAVSVAVSLMFGILMFLLPDSVFQNIAGRPDRLIENKHGIVAVYHRDGDKVVYGANVYDGAYNTDIFNSVNGIERAYLLPSLKSGIRRIFVVGLSTGSWARVLSAIPEMQSMIVAEINPAYRSLIADEPQIAPLLQDKRVEIVLDDGRKWLRRHPDEKFDLILMNSTWYWRAYSTNLLSAEFLKQVQSHLTPDGIVMFNTTHSPHAFATAVHSIPYAYRYGHMVVGSATPVVFPNKELLKQRLSRLIWPESGRHVFDSSTVDAAAQKVVSRMLIRMTEPSAGAEVITDDNMIVEYKYGRGI

SEQ ID NO: 1321 - DNA, 1494 bp, Neisseria meningitidis
  misc_feature (47)..(47): n is a, c, g, or t
atggatatagtgaacactaaaccgaatactagtttgatttatatgcnttctttccttagcggcttattgagcttgggtatagaagtcttgtgggtgaggatgttttcgttcgcagcacagtccgtgcctcaggcattttcatttacccttgcctgttttctgaccggtatcgccgtcggcgcgtattttggcaaacggatttgccgcagccgctttgttgatattccctttatcgggcagtgcttcttgtgggcgggtattgccgactttttgattttgggtgctgcgtggttgttgacgggtttttccggcttcgtccaccacgccggtatcttcattaccctgtctgccgtcgtcasasggttgattttcccgctcgtacaccatgtgggtacggatggcaacaaatccggacgacaggtttccaatgtttatttcgccamcgttgccggcagtgcattgggtccggtccttatcggctttgtgatacttgatttcttgtccacccaacagatttacctgctcatctgtwtgatttctgctgctgtccctttgttttgtacactgttccaaaaaagtctccgactgaatgcagtgtcggtagcagtttccctaatgttcggcatcctcatgttcytactgccggattctgtctttcaaaatattgctgaccgtccggataggctgattgaaaacaaacacggcattgttgcggtttaccatagagatggtgataaggttgtttatggggcgaatgtatacgacggcgcatacaataccgatgtattcaatagtgtcaacggcatcgaacgtgcctatctgctaccctccctgaagtctggcatacgccgcattttcgtcgttggactgagtacaggttcgtgggcgcgcgtcttgtctgccattccggaaatgcagtcgatgatcgttgcggaaatcaatccggcataccgtagccttatcgcggacgagccgcaaatcgccccgcttttgcaggacaaacgtgttgaaattgtattggatgacggtaggaaatggctgcgtcgccatcctgatgaaaaattcgacctgattttgatgaatacgacttggtactggcgtgcctattccaccaacctgttgagtgcggaatttttaaaacaggtgcaaagccaccttaccccggatggtattgtaatgtttaataccacgcacagcccgcatgcttttgctaccgccgtacacagtattccctatgcataccgctatgggcatatggtagtcggctcggcaaccccggtagttttccctaataaagaactgctcaagcaacgtctctcccggttgatttggccggaaagcggcaggcacgtatttgacagcagcaccgtggatgctgcagcacaaaaggttgtctctcgtatgctgattcagatgacggaaccttcggctggggcggaagttattaccgacgataatatgattgtagaatacaaatacggcagagggatttaa

SEQ ID NO: 1322 - protein, 497 aa, Neisseria meningitidis
  misc_feature (16)..(16): Xaa can be any naturally occurring amino acid
  misc_feature (120)..(121): Xaa can be any naturally occurring amino acid
  misc_feature (148)..(148): Xaa can be any naturally occurring amino acid
  misc_feature (178)..(178): Xaa can be any naturally occurring amino acid
MDIVNTKPNTSLIYMXSFLSGLLSLGIEVLWVRMFSFAAQSVPQAFSFTLACFLTGIAVGAYFGKRICRSRFVDIPFIGQCFLWAGIADFLILGAAWLLTGFSGFVHHAGIFITLSAVVXXLIFPLVHHVGTDGNKSGRQVSNVYFAXVAGSALGPVLIGFVILDFLSTQQIYLLICXISAAVPLFCTLFQKSLRLNAVSVAVSLMFGILMFLLPDSVFQNIADRPDRLIENKHGIVAVYHRDGDKVVYGANVYDGAYNTDVFNSVNGIERAYLLPSLKSGIRRIFVVGLSTGSWARVLSAIPEMQSMIVAEINPAYRSLIADEPQIAPLLQDKRVEIVLDDGRKWLRRHPDEKFDLILMNTTWYWRAYSTNLLSAEFLKQVQSHLTPDGIVMFNTTHSPHAFATAVHSIPYAYRYGHMVVGSATPVVFPNKELLKQRLSRLIWPESGRHVFDSSTVDAAAQKVVSRMLIQMTEPSAGAEVITDDNMIVEYKYGRGI

SEQ ID NO: 1323 - DNA, 1494 bp, Neisseria meningitidis
atggatatagtgaacactaaaccgaatactagtttgatttatatgctttctttccttagcggcttattgagcttgggtatagaagtcttgtgggtaaggatgttttcgttcgcagcacagtccgtgcctcaggcattttcatttactcttgcctgttttctgaccggtatcgccgtcggcgcgtattttggcaaacggatttgccgcagccgctttgttgatattccctttatcgggcagtgcttcttgtgggcgggtattgccgactttttgattttgggtgctgcgtggttgttgacgggtttttccggcttcgtccaccacgccggtatcttcattaccctgtctgccgtcgtcagagggttgattttcccgctcgtacaccatgtgggtacggatggcaacaaatccggacgacaggtttccaatgtttatttcgccaacgttgccggcagtgcattgggtccggtccttatcggctttgtgatacttgatttcttgtccacccaacagatttacctgctcatctgtttgatttctgctgctgtccctttgttttgtacactgttccaaaaaagtctccgactgaatgcagtgtcggtagcagtttccctaatgttcggcatcctcatgttcctactgccggattctgtctttcaaaatattgctgaccgtccggataggctgattgaaaacaaacacggcattgttgcggtttaccatagagatggtgataaggttgtttatggggcgaatgtatacgacggcgcatacaataccgatgtattcaatagtgtcaacggcatcgaacgtgcctatctgctaccctccctgaagtctggcatacgccgcattttcgtcgttggattgagtacaggttcgtgggcgcgcgtcttgtctgccattccggaaatgcagtcgatgatcgttgcggaaatcaatccggcataccgtagccttatcgcggacgagccgcaaatcgccccgcttttgcaggacaaacgtgttgaaattgtattggatgacggtaggaaatggctgcgtcgccatcctgatgaaaaattcgacctgattttgatgaatacgacttggtactggcgtgcctattccaccaacctgttgagtgcggaatttttaaaacaggtgcaaagccaccttaccccggatggtattgtaatgtttaataccacgcacagcccgcatgcttttgctaccgccgtacacagtattccctatgcataccgctatgggcatatggtagtcggctcggcaaccccggtagttttccctaataaagaactgctcaagcaacgtctctcccggttgatttggccggaaagcggcaggcacgtatttgacagcagcaccgtggatgctgcagcacaaaaggttgtctctcgtatgctgattcagatgacggaaccttcggctggtgcggaagtcattaccgacgataatatgattgtagaatacaaatacggcagagggatttaa

SEQ ID NO: 1324 - protein, 497 aa, Neisseria meningitidis
MDIVNTKPNTSLIYMLSFLSGLLSLGIEVLWVRMFSFAAQSVPQAFSFTLACFLTGIAVGAYFGKRICRSRFVDIPFIGQCFLWAGIADFLILGAAWLLTGFSGFVHHAGIFITLSAVVRGLIFPLVHHVGTDGNKSGRQVSNVYFANVAGSALGPVLIGFVILDFLSTQQIYLLICLISAAVPLFCTLFQKSLRLNAVSVAVSLMFGILMFLLPDSVFQNIADRPDRLIENKHGIVAVYHRDGDKVVYGANVYDGAYNTDVFNSVNGIERAYLLPSLKSGIRRIFVVGLSTGSWARVLSAIPEMQSMIVAEINPAYRSLIADEPQIAPLLQDKRVEIVLDDGRKWLRRHPDEKFDLILMNTTWYWRAYSTNLLSAEFLKQVQSHLTPDGIVMFNTTHSPHAFATAVHSIPYAYRYGHMVVGSATPVVFPNKELLKQRLSRLIWPESGRHVFDSSTVDAAAQKVVSRMLIQMTEPSAGAEVITDDNMIVEYKYGRGI

SEQ ID NO: 1325 - DNA, 963 bp, Neisseria gonorrhoeae
atgcgggcacggctgctgatacctattcttttttcagtttttattttatccgcctgcgggacactgacaggtattccatcgcatggcggaggcaaacgcttcgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgcggcgaatacataaacagccctgccgtccgcaccgattacacctatccgcgttacgaaaccaccgctgaaacaacatcaggcggtttgacgggtttaaccacttctttatctacacttaatgcccctgcactctcgcgcacccaatcagacggtagcggaagtaggagcagtctgggcttaaatattggcgggatgggggattatcgaaatgaaaccttgacgaccaacccgcgcgacactgcctttctttcccacttggtgcagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaacccaaaaccaatgcgtttgaagctgcctataaagaaaattacgcattgtggatggggccgtataaagtaagcaaaggaatcaaaccgacggaaggattgatggtcgatttctccgatatccaaccatacggcaatcatacgggtaactccgccccatccgtagaggctgataacagtcatgaggggtatggatacagcgatgaagcagtgcgacaacatagacaagggcaaccttga

SEQ ID NO: 1326 - protein, 320 aa, Neisseria gonorrhoeae
MRARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSRSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHTGNSAPSVEADNSHEGYGYSDEAVRQHRQGQP

SEQ ID NO: 1327 - DNA, 963 bp, Neisseria meningitidis
atgcaagcacggctgctgatacctattcttttttcagtttttattttatccgcctgcgggacactgacaggtattccatcgcatggcggaggtaaacgctttgcggtcgaacaagaacttgtggccgcttctgccagagctgccgttaaagacatggatttacaggcattacacggacgaaaagttgcattgtacattgccactatgggcgaccaaggttcaggcagtttgacagggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctctcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacagatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatggggccgtataaagtaagcaaaggaattaaaccgacggaaggattaatggtcgatttctccgatatccgaccatacggcaatcatacgggtaactccgccccatccgtagaggctgataacagtcatgaggggtatggatacagcgatgaagtagtgcgacaacatagacaaggacaaccttga

SEQ ID NO: 1328 - protein, 320 aa, Neisseria meningitidis
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIRPYGNHTGNSAPSVEADNSHEGYGYSDEVVRQHRQGQP

SEQ ID NO: 1329 - DNA, 963 bp, Neisseria meningitidis
atgcaagcacggctgctgatacctattcttttttcagtttttattttatccgcctgcgggacactgacaggtattccatcgcatggcggaggtaaacgcttcgcggtcgaacaagaacttgtggccgcttctgccagagctgccgttaaagacatggatttacaggcattacacggacgaaaagttgcattgtacattgcaactatgggcgaccaaggttcaggcagtttgacagggggtcgctactccattgatgcactgattcgtggcgaatacataaacagccctgccgtccgtaccgattacacctatccacgttacgaaaccaccgctgaaacaacatcaggcggtttgacaggtttaaccacttctttatctacacttaatgcccctgcactctcgcgcacccaatcagacggtagcggaagtaaaagcagtctgggcttaaatattggcgggatgggggattatcgaaatgaaaccttgacgactaacccgcgcgacactgcctttctttcccacttggtacagaccgtatttttcctgcgcggcatagacgttgtttctcctgccaatgccgatacggatgtgtttattaacatcgacgtattcggaacgatacgcaacagaaccgaaatgcacctatacaatgccgaaacactgaaagcccaaacaaaactggaatatttcgcagtagacagaaccaataaaaaattgctcatcaaaccaaaaaccaatgcgtttgaagctgcctataaagaaaattacgcattgtggatgggaccgtataaagtaagcaaaggaattaaaccgacagaaggattaatggtcgatttctccgatatccaaccatacggcaatcatatgggtaactctgccccatccgtagaggctgataacagtcatgaggggtatggatacagcgatgaagcagtgcgacgacatagacaagggcaaccttga

SEQ ID NO: 1330 - protein, 320 aa, Neisseria meningitidis
MQARLLIPILFSVFILSACGTLTGIPSHGGGKRFAVEQELVAASARAAVKDMDLQALHGRKVALYIATMGDQGSGSLTGGRYSIDALIRGEYINSPAVRTDYTYPRYETTAETTSGGLTGLTTSLSTLNAPALSRTQSDGSGSKSSLGLNIGGMGDYRNETLTTNPRDTAFLSHLVQTVFFLRGIDVVSPANADTDVFINIDVFGTIRNRTEMHLYNAETLKAQTKLEYFAVDRTNKKLLIKPKTNAFEAAYKENYALWMGPYKVSKGIKPTEGLMVDFSDIQPYGNHMGNSAPSVEADNSHEGYGYSDEAVRRHRQGQP

SEQ ID NO: 1331 - DNA, 1677 bp, Neisseria gonorrhoeae
atggtcggacggaccttgaccgcagataccgacatatttgttctgcttgcggcaggcggagatggcaagatgcagcatcactttgacggcagggttgcgttcgtcaaacgattcggacaccaagccgctgtctcggtcgaggccgagggtcagctgggtcatgtcgttcgagccgatggagaagccgtcgaagtattgcaggaattgttccgccaataccgcgttgctcggcagctcgcacatcataatcaggcgcaggccgtttttgccgcgttccaagccgttttctttcaatgccttaaccactgcttcggcttcgcccaaagtgcggacgaacggaatcatgatttcgacgttggtcagacccatttcgtcacgaacgcgtttcaaggctttgcattccaaggcgaaacagtctttgaagctctcggcaacataacgcgccgcaccacggaagcccaacatcgggttttcttcatgcggttcgtatacgctgccgccgaccaggttggcgtattcgttggatttgaagtcggacatacggacgatggttttacgcggataaaccgatgcggcaagcgttgccacgccttcggcgattttatcgacgtagaagtcgacaggggatgcgtaaccggcgatgcggcggataatttccgctttcagttcgtcgtcttgtttgtcaaattccaacaaggctttcgggtggatgccgatttggcggttgatgataaattccatacgcgccaagccgatgccttcgctgggcagattggcgaagctgaatgcgagttcgggattgccgacgttcatcatgactttgacgggtgcttttggcatattgtccaaggcgacatcggtaatttgtacgtccagcaggccggcatagataaagccggtatcgccttcggcacaggatacggtaacttcctgaccgttttccaagagttcggtcgcattgccgcagccgacgacggcaggaatacccagttcgcgcgcgatgatggcggcgtggcaggtgcgtccgccgcggttggtcacgatggcggaagcacgtttcatcacgggttcccaatccggatcggtcatgtcggtaaccagtacgtcgccggcttcgacggaatccatctcggaagcatctttaatcaggcgcaccttgccctgaccgactttttgaccgatggcacgaccttcgcacaagacggttttttcgccgttgatggcgtagcggcgcaggttgcggctgccttcttcttgggatttgacggtttcggggcgggcttgcaggatgtagagtttgccgtccaggccgtcgcgtccccattcgatatccatcgggcggccgtagtgtttttcgatggtcagcgcgtagtgtgccaactcggtgatttcttcgtcggtaatggagaagcggttgcggtcttcttcggggacttcgacgttggttaccgatttgccggcttcggctttgtcggtgaaaatcattttgatgtgtttcgaacccatggtcttgcgcaggatggcgggtttgcctgctttgagcgtgggtttgaacacataaaattcgtccgggttgaccgcgccttgtacgacgttttcgcccagaccgtaagaggaggtaacaaagacgacttggttgtagccggattcggtgtcgagggtgaacatcacacctga

SEQ ID NO: 1332 - protein, 558 aa, Neisseria gonorrhoeae
MVGRTLTADTDIFVLLAAGGDGKMQHHFDGRVAFVKRFGHQAAVSVEAEGQLGHVVRADGEAVEVLQELFRQYRVARQLAHHNQAQAVFAAFQAVFFQCLNHCFGFAQSADERNHDFDVGQTHFVTNAFQGFAFQGETVFEALGNITRRTTEAQHRVFFMRFVYAAADQVGVFVGFEVGHTDDGFTRINRCGKRCHAFGDFIDVEVDRGCVTGDAADNFRFQFVVLFVKFQQGFRVDADLAVDDKFHTRQADAFAGQIGEAECEFGIADVHHDFDGCFWHIVQGDIGNLYVQQAGIDKAGIAFGTGYGNFLTVFQEFGRIAAADDGRNTQFARDDGGVAGASAAVGHDGGSTFHHGFPIRIGHVGNQYVAGFDGIHLGSIFNQAHLALTDFLTDGTTFAQDGFFAVDGVAAQVAAAFFLGFDGFGAGLQDVEFAVQAVASPFDIHRAAVVFFDGQRVVCQLGDFFVGNGEAVAVFFGDFDVGYRFAGFGFVGENHFDVFRTHGLAQDGGFACFERGFEHIKFVRVDRALYDVFAQTVRGGNKDDLVVAGFGVEGEHHT

SEQ ID NO: 1333 - DNA, 1677 bp, Neisseria meningitidis
atggtcggacsggccttgaccgcagatgccgacatatttgttctgcttgcggcaggcggagatggcaaggtgcagcatcactttgacggcagggttgcgttcgtcaaacgattcggataccaagccgctgtcgcggtcgagaccgagggtcagttgggtcatgtcgttcgagccgatggagaagccgtcgaagtattgcaggaattgttccgccaataccgcgttgctcggcagctcgcacatcataatcaggcgcaggccgtttttgccgcgttccaagccgttttctttcagggctttgacaacggmttcggcttcgcccaaagtgcggacgaacggaatcatgatttcaacgttggycaaccccatttcatcgcggacgcgtttcaaggctttgcattccaaggcgaaacagtctttgaagttgtcggcgacataacgcgccgcaccacggaagcccaacatcgggttttcttcatgcggttcgtatacgttgccgccgaccaggttggcgtattcgttggatttgaagtcggacatacggacgatggttttacgcggataaaccgatgcggccaatgtcgccacgccttcggcgattttatcgacgtagaagtcgacaggggacgcgtaaccggcgatacggcgggtaatttccgcttttaattcgtcgtcttgtttgtcaaattccaacaargctttggggtggataccgatttggcggttgatgataaattccatacgcgccaagccgatgccttcgctgggcaggttggcgaagctgaatgcgagttcgggattgccgacgttcatcatgacttttacaggtgctttaggcatattgtctaaggcgacatcggtaatctgtacgtccaacagaccggcatagataaagccggtatcgccttcggcacaggatacggtaacttcttgaccgtttttcagcaattcggttgcattgccgcagccgacaacggcaggaatgcccaattcacgcgcgatgatggcggcgtggcaggtacggccgccgcggttggtaacgatggcagaagcacgtttcatcacgggttcccaatccggatcggtcatgtcggtaacgagtacgtcgccggcttcgacggaatccatctcggaagcatctttaatcaggcgcaccttgccctgaccgactttctgaccgatggcgcggccttcgcataatacggttttgtcgccgttgatggcgaagcggcgcaggttgcggttgccctcttcttgggattttacggtttcgggacgggcttgcaggatgtagagtttgccgtccaagccgtcgcgtccccattcgatatccatcgggcggccgtagtgtttttcgatggtcagtgcgtaatgcgccaactcagtaatttcttcgtcggtaatggagaagcggttgcggtcttcctcggggacatcgacgttggttacggatttaccggcttctgctttgtcggtaaaaatcattttgatgtgttttgaacccatggttttacgcaggatggcgggcttgcccgytttgagcgtgggtttgaacacatraaattcgtccgggttgaccgcaccttgtacgacgttttcgcccagaccgtaagaggaggtaacaaagacgacytgatcgtakccggattcggtgtcgagggtgaacatcacacctga

SEQ ID NO: 1334 - protein, 558 aa, Neisseria meningitidis
  misc_feature (4)..(4): Xaa can be any naturally occurring amino acid
  misc_feature (222)..(222): Xaa can be any naturally occurring amino acid
  misc_feature (233)..(233): Xaa can be any naturally occurring amino acid
  misc_feature (283)..(283): Xaa can be any naturally occurring amino acid
  misc_feature (400)..(400): Xaa can be any naturally occurring amino acid
  misc_feature (500)..(500): Xaa can be any naturally occurring amino acid
  misc_feature (520)..(520): Xaa can be any naturally occurring amino acid
  misc_feature (548)..(548): Xaa can be any naturally occurring amino acid
MVGXALTADADIFVLLAAGGDGKVQHHFDGRVAFVKRFGYQAAVAVETEGQLGHVVRADGEAVEVLQELFRQYRVARQLAHHNQAQAVFAAFQAVFFQGFDNGFGFAQSADERNHDFNVGQPHFIADAFQGFAFQGETVFEVVGDITRRTTEAQHRVFFMRFVYVAADQVGVFVGFEVGHTDDGFTRINRCGQCRHAFGDFIDVEVDRGRVTGDTAGNFRFXFVVLFVKFQQXFGVDTDLAVDDKFHTRQADAFAGQVGEAECEFGIADVHHDFYRCFRHIVXGDIGNLYVQQTGIDKAGIAFGTGYGNFLTVFQQFGCIAAADNGRNAQFTRDDGGVAGTAAAVGNDGRSTFHHGFPIRIGHVGNEYVAGFDGIHLGSIFNQAHLALTDFLTDGAAFAXYGFVAVDGEAAQVAVALFLGFYGFGTGLQDVEFAVQAVASPFDIHRAAVVFFDGQCVMRQLSNFFVGNGEAVAVFLGDIDVGYGFTGFCFVGKNHFDVFXTHGFTQDGGLARFERGFEHXKFVRVDRTLYDVFAQTVRGGNKDDLIVXGFGVEGEHHT

SEQ ID NO: 1335 - DNA, 1671 bp, Neisseria meningitidis
atggtcggacgggccttgaccgcagatgccgacatatttgttctgcttgcggcaggcggagatggcaaggtgcagcatcactttgacggcagggttgcgttcgtcaaacgattcggataccaagccgctgtcgcggtcgagaccgagggtcagttgggtcatgtcgttcgagccgatggagaagccgtcgaagtattgcaggaattgttccgccaataccgcgttgctcggcagctcgcacatcataatcaggcgcaggccgtttttgccgcgttccaagccgttttctttcagggctttgacaacggcttcggcttcgcccaaagtgcggacgaacggaatcatgatttcaacgttggtcaaccccatttcatcgcggacgcgtttcaaggctttgcattccaaggcgaaacagtctttgaagttgtcggcgacataacgcgccgcaccacggaagcccaacatcgggttttcttcatgcggttcgtatacgttgccgccgaccaggttggcgtattcgttggatttgaagtcggacatacggacgatggttttacgcggataaaccgatgcggccaatgtcgccacgccttcggcgattttatcgacgtagaagtcgacaggggacgcgtaaccggcgatacggcgggtaatttccgcttttaattcgtcgtcttgtttgtcaaattccaacaaggctttggggtggataccgatttggcggttgatgataaattccatacgcgccaagccgatgccttcgctgggcaggttggcgaagctgaatgcgagttcgggattgccgacgttcatcatgacttttacaggtgctttaggcatgttgtccaaagcaacatcggtaatttgtacgtccagcaggccggagtagatgaagccggtatcgccttcggcacaggatacggtaacttcttgaccgtttttcagcaattcggttgcattgccgcagccgacaacggcaggaatacccagttcgcgcgcgatgatggcggcgtggcaggtacgtccgcccctgttggtcacgatggcggaagcgcgtttcatcaccggttcccaatctgggtcggtcatgtcggtaaccagtacgtcgccggcttcgacggaatccatctcggaagcatctttaatcaggcgtaccttgccctgaccgactttctgaccgatggcgcggccttcgcacaagacggttttttcgccgttgatagaaaagcggcgcaggttgcggctgccttcttcctgggatttgacggtttcgggacgggcttgcaggatgtagagtttgccgtccaagccgtcgcgtccccattcgatgtccatcgggcggccgtagtgtttttcgatggtcagtgcgtaatgcgccaactcggtgatttcttcgtcggtaatggagaagcggttgcggtcttcttcggggacatcgacgttggttaccgatttgccggcttctgctttgtcggtaaaaatcattttgatgtgttttgagcccatggttttgcgcaggatggcaggtttgcctgctttcagcgtgggtttgaacacatagaattcgtcgggattgactgcgccttgtacgacgttttcgcccagaccgtaggatgaagtgacaaagacgacttggtcgtaaccggattcggtatcgagggtgaacatcac

SEQ ID NO: 1336 - protein, 554 aa, Neisseria meningitidis
MVGRALTADADIFVLLAAGGDGKVQHHFDGRVAFVKRFGYQAAVAVETEGQLGHVVRADGEAVEVLQELFRQYRVARQLAHHNQAQAVFAAFQAVFFQGFDNGFGFAQSADERNHDFNVGQPHFIADAFQGFAFQGETVFEVVGDITRRTTEAQHRVFFMRFVYVAADQVGVFVGFEVGHTDDGFTRINRCGQCRHAFGDFIDVEVDRGRVTGDTAGNFRFFVVLFVKFQQGFGVDTDLAVDDKFHTRQADAFAGQVGEAECEFGIADVHHDFYRCFRHVVQSNIGNLYVQQAGVDEAGIAFGTGYGNFLTVFQQFGCIAAADNGRNTQFARDDGGVAGTSAPVGHDGGSAFHHRFPIWVGHVGNQYVAGFDGIHLGSIFNQAYLALTDFLTDGAAFAQDGFFAVDRKAAQVAAAFFLGFDGFGTGLQDVEFAVQAVASPFDVHRAAVVFFDGQCVMRQLGDFFVGNGEAVAVFFGDIDVGYRFAGFCFVGKNHFDVFAHGFAQDGRFACFQRGFEHIEFVGIDCALYDVFAQTVGSDKDDLVVTGFGIEGEHH

SEQ ID NO: 1337 - DNA, 507 bp, Neisseria gonorrhoeae
atgatgaaaccgcacaacctgttccaattcctcgccgtttgctccctgaccgtcgccgtcgcttccgcacaggcgggcgcggtggacgcgctcaagcaattcaacaacgatgccgacggtatcagcggcagcttcacccaaaccgtccaaagcaaaaagaaaacccaaaccgcgcacggcacgttcaaaatcctgcgcccgggcctcttcaaatgggaatacactttgccctacagacagactattgtcggcgacggtcaaaccgtttggctctacgatgttgatttggcacaagtgaccaagtcgtcccaagaccaggccatcggcggcagccccgccgccatcctgtcgaacaaaaccgccctcgaaagcagttacacgctgaaagaggacggttcgtccaacggcatcgattatgtgcggggcaacgcccaaacgcaacaacgccggctaccaatacatccgcatcggcttcaaaggcggcaacctcgccgccatgcagcttaa

SEQ ID NO: 1338 - protein, 168 aa, Neisseria gonorrhoeae
MMKPHNLFQFLAVCSLTVAVASAQAGAVDALKQFNNDADGISGSFTQTVQSKKKTQTAHGTFKILRPGLFKWEYTLPYRQTIVGDGQTVWLYDVDLAQVTKSSQDQAIGGSPAAILSNKTALESSYTLKEDGSSNGIDYVRGNAQTQQRRLPIHPHRLQRRQPRRHAA

SEQ ID NO: 1339 - DNA, 503 bp, Neisseria meningitidis
atgatgaaaccgcacaacctgttccaattcctcgccgtttgctccctgaccgtcgccgtcgcttccgcacaggcgggcgcggtagacgcgcttaagcaattcaacaacgatgccgacggtatcagcggcagcttcacccaamccgtccaawgcaaaaagaaaacccaaaccgcgcacggcacgttcaaaatcctgcgaccgggccttttcaaatgggaatacaccaaacttacaggcaaaccatcgtcggcgacggtcaaacygtttggctmtacgatgtygatctggcacaagtgaccaagtcgtcccaagaccaggccataggcgscagccccgccgccatcctgtcgaacaaarccgccctcgaaagcagctacacgctgaaagaggacggttcgtccaacggcatcgattatgtgggcaacgcccaaacgcaacaacgccggctaccaatacatccgcatcggcttcaaaggcggcaacctcgccgccatgcagctyaa

SEQ ID NO: 1340 - protein, 168 aa, Neisseria meningitidis
  misc_feature (48)..(48): Xaa can be any naturally occurring amino acid
  misc_feature (51)..(51): Xaa can be any naturally occurring amino acid
  misc_feature (110)..(110): Xaa can be any naturally occurring amino acid
  misc_feature (120)..(120): Xaa can be any naturally occurring amino acid
  misc_feature (168)..(168): Xaa can be any naturally occurring amino acid
MMKPHNLFQFLAVCSLTVAVASAQAGAVDALKQFNNDADGISGSFTQXVQXKKKTQTAHGTFKILRPGLFKWEYTKLYRQTIVGDGQTVWLYDVDLAQVTKSSQDQAIGXSPAAILSNKXALESSYTLKEDGSSNGIDYVGNAQTQQRRLPIHPHRLQRRQPRRHAAX

SEQ ID NO: 1341 - DNA, 504 bp, Neisseria meningitidis
atgatgaaaccgcacaacctgttccaattcctcgccgtttgctccctgaccgtctccgtcgcttccgcacaggcgggcgcggtggacgcgctcaagcaattcaacaacgatgccgacggtatcagcggcagcttcacccaaaccgtccaaagcaaaaagaaaacccaaaccgcgcacggcacgttcaaaatcctgcgcccgggcctctttaaatgggaatacacttcgccttacaaacagactattgtcggcgacggtcaaaccgtttggctctacgatgtcgatttggcacaagtgaccaagtcgtcccaagaccaggccataggcggcagccccgccgccatcctgtcgaacaaaaccgccctcgaaagcagctacacgctgaaagaggacggttcgtccaacggcatcgattatgtgggcaacgcccaaacgcaacaacgccggctaccaatacatccgcatcggcttcaaaggcggcaacctcgccgccatgcagcttaa

SEQ ID NO: 1342 - protein, 167 aa, Neisseria meningitidis
MMKPHNLFQFLAVCSLTVSVASAQAGAVDALKQFNNDADGISGSFTQTVQSKKKTQTAHGTFKILRPGLFKWEYTSPYKQTIVGDGQTVWLYDVDLAQVTKSSQDQAIGGSPAAILSNKTALESSYTLKEDGSSNGIDYVGNAQTQQRRLPIHPHRLQRRQPRRHAA

SEQ ID NO: 1343 - DNA, 624 bp, Neisseria gonorrhoeae
atgatgaaaccgcacaacctgttccaattcctcgccgtttgctccctgaccgtcgccgtcgcttccgcacaggcgggcgcggtggacgcgctcaagcaattcaacaacgatgccgacggtatcagcggcagcttcacccaaaccgtccaaagcaaaaagaaaacccaaaccgcgcacggcacgttcaaaatcctgcgcccgggcctcttcaaatgggaatacactttgccctacagacagactattgtcggcgacggtcaaaccgtttggctctacgatgttgatttggcacaagtgaccaagtcgtcccaagaccaggccatcggcggcagccccgccgccatcctgtcgaacaaaaccgccctcgaaagcagttacacgctgaaagaggacggttcgtccaacggcatcgattatgtgcgggcaacgcccaaacgcaacaacgccggctaccaatacatccgcatcggcttcaaaggcggcaacctcgccgccatgcagcttaaagacagcttcggcaaccaaacctccatcagtttcggcggtttgaataccaatccccaactctcgcgcggcgcgttcaagtttaccccgcccaaaggcgtggacgtgttgagcaactga

SEQ ID NO: 1344 - protein, 207 aa, Neisseria gonorrhoeae
MMKPHNLFQFLAVCSLTVAVASAQAGAVDALKQFNNDADGISGSFTQTVQSKKKTQTAHGTFKILRPGLFKWEYTLPYRQTIVGDGQTVWLYDVDLAQVTKSSQDQAIGGSPAAILSNKTALESSYTLKEDGSSNGIDYVRATPKRNNAGYQYIRIGFKGGNLAAMQLKDSFGNQTSISFGGLNTNPQLSRGAFKFTPPKGVDVLSN

SEQ ID NO: 1345 - DNA, 624 bp, Neisseria meningitidis
atgatgaaaccgcacaacctgttccaattcctcgccgtttgctccctgaccgtcgccgtcgcttccgcacaggcgggcgcggtagacgcgcttaagcaattcaacaacgatgccgacggtatcagcggcagcttcacccaaaccgtccaaagcaaaaagaaaacccaaaccgcgcacggcacgttcaaaatcctgcgaccgggccttttcaaatgggaatacaccaaaccttacaggcaaaccatcgtcggcgacggtcaaaccgtttggctctacgatgttgatctggcacaagtgaccaagtcgtcccaagaccaggccataggcggcagccccgccgccatcctgtcgaacaaaaccgccctcgaaagcagctacacgctgaaagaggacggttcgtccaacggcatcgattatgtgctggcaacgcccaaacgcaacaacgccggctaccaatacatccgcatcggcttcaaaggcggcaacctcgccgccatgcagcttaaagacagcttcggcaaccaaacctccatcagtttcggcggtttgaataccaatccccaactctcgcgcggcgcgttcaagtttaccccgcccaaaggcgtggacgtgttgagcaactga

SEQ ID NO: 1346 - protein, 207 aa, Neisseria meningitidis
MMKPHNLFQFLAVCSLTVAVASAQAGAVDALKQFNNDADGISGSFTQTVQSKKKTQTAHGTFKILRPGLFKWEYTKPYRQTIVGDGQTVWLYDVDLAQVTKSSQDQAIGGSPAAILSNKTALESSYTLKEDGSSNGIDYVLATPKRNNAGYQYIRIGFKGGNLAAMQLKDSFGNQTSISFGGLNTNPQLSRGAFKFTPPKGVDVLSN

SEQ ID NO: 1347 - DNA, 624 bp, Neisseria meningitidis
atgatgaaaccgcacaacctgttccaattcctcgccgtttgctccctgaccgtctccgtcgcttccgcacaggcgggcgcggtggacgcgctcaagcaattcaacaacgatgccgacggtatcagcggcagcttcacccaaaccgtccaaagcaaaaagaaaacccaaaccgcgcacggcacgttcaaaatcctgcgcccgggcctctttaaatgggaatacacttcgccttacaaacagactattgtcggcgacggtcaaaccgtttggctctacgatgtcgatttggcacaagtgaccaagtcgtcccaagaccaggccataggcggcagccccgccgccatcctgtcgaacaaaaccgccctcgaaagcagctacacgctgaaagaggacggttcgtccaacggcatcgattatgtgctggcaacgcccaaacgcaacaacgccggctaccaatacatccgcatcggcttcaaaggcggcaacctcgccgccatgcagcttaaagacagcttcggcaatcaaacctccatcagtttcggcggtttgaataccaatccccaactctcgcgcggcgcgttcaagtttaccccgcccaaaggcgtggacgtgttgagcaactga

SEQ ID NO: 1348 - protein, 207 aa, Neisseria meningitidis
MMKPHNLFQFLAVCSLTVSVASAQAGAVDALKQFNNDADGISGSFTQTVQSKKKTQTAHGTFKILRPGLFKWEYTSPYKQTIVGDGQTVWLYDVDLAQVTKSSQDQAIGGSPAAILSNKTALESSYTLKEDGSSNGIDYVLATPKRNNAGYQYIRIGFKGGNLAAMQLKDSFGNQTSISFGGLNTNPQLSRGAFKFTPPKGVDVLSN

SEQ ID NO: 1349 - DNA, 207 bp, Neisseria gonorrhoeae
atgtccgcgccgtcggcatcggtaatcattttgttccatgccgcttcgatttcggcatcgagctgttcggggaagggcgtgtccaaaatccattggcggatttctttgccgacgcgtgccagttcggaaacgtcttcgacatccaattttgccagagcggcggaaatgcgttcgttcagaccgttgtgtgcgagaaatgcgcggtag

SEQ ID NO: 1350 - protein, 68 aa, Neisseria gonorrhoeae
MSAPSASVIILFHAASISASSCSGKGVSKIHWRISLPTRASSETSSTSNFARAAEMRSFRPLCARNAR

SEQ ID NO: 1351 - DNA, 207 bp, Neisseria meningitidis
atgtccgcaccgccggcatcggcaaccattttgttccatgccgcttcgatttcggcatcgagctgttcggggaaaggcgtatccaaaatccattggcggatttctttgccgacgcgtgccagttcggcaacgtcttcgacatccaattttgccagtgcggcggaaatgcgttcgctcagaccgttgtgtgcgaggaatgcgcggtag

SEQ ID NO: 1352 - protein, 68 aa, Neisseria meningitidis
MSAPPASATILFHAASISASSCSGKGVSKIHWRISLPTRASSATSSTSNFASAAEMRSLRPLCARNAR

SEQ ID NO: 1353 - DNA, 207 bp, Neisseria meningitidis
atgtccgcgccgccggcatcggcaaccattttgttccatgccgcttcgatttcggcatcgagctgttcggggaagggcgtgtccaaaatccattggcggatttctttgccgacgcgtgccagttcggcaacgtcttcgacatctaattttgccagtgcggcggaaatgcgttcgctcagaccgttgtgtgcgaggaatgcgcggtag

SEQ ID NO: 1354 - protein, 207 aa, Neisseria meningitidis
ATGTCCGCGCCGCCGGCATCGGCAACCATTTTGTTCCATGCCGCTTCGATTTCGGCATCGAGCTGTTCGGGGAAGGGCGTGTCCAAAATCCATTGGCGGATTTCTTTGCCGACGCGTGCCAGTTCGGCAACGTCTTCGACATCTAATTTTGCCAGTGCGGCGGAAATGCGTTCGCTCAGACCGTTGTGTGCGAGGAATGCGCGGTAG

SEQ ID NO: 1355 - DNA, 360 bp, Neisseria gonorrhoeae
atggcgcggtcgttgtacagggaggcgaaaacgtggcgcatcgcttttttaacgttatccaagccattgatattcaggaaggtttcctgttggccggcaaatgatgcgtcgggcaggtcttcggcggttgcggaagagcgtacggcaacggaaatgtccgcgccgtcggcatcggtaatcattttgttccatgccgcttcgatttcggcatcgagctgttcggggaagggcgtgtccaaaatccattggcggatttctttgccgacgcgtgccagttcggaaacgtcttcgacatccaattttgccagagcggcggaaatgcgttcgttcagaccgttgtgtgcgagaaatgcgcggtag

SEQ ID NO: 1356 - protein, 119 aa, Neisseria gonorrhoeae
MARSLYREAKTWRIAFLTLSKPLIFRKVSCWPANDASGRSSAVAEERTATEMSAPSASVIILFHAASISASSCSGKGVSKIHWRISLPTRASSETSSTSNFARAAEMRSFRPLCARNAR

SEQ ID NO: 1357 - DNA, 360 bp, Neisseria meningitidis
atggcacggtcgttatacagggaagcgaatacatggtgcatcgcttctttaacgttatccaagccgttgatgttcaagaaggtttcctgttgtccagcgaatgatgcgtccggcaggtcttcggcagttgcggaagaacgtacggcaacggaaatgtccgcaccgccggcatcggcaaccattttgttccatgccgcttcgatttcggcatcgagctgttcggggaaaggcgtatccaaaatccattggcggatttctttgccgacgcgtgccagttcggcaacgtcttcgacatccaattttgccagtgcggcggaaatgcgttcgctcagaccgttgtgtgcgaggaatgcgcggtag

SEQ ID NO: 1358 - protein, 119 aa, Neisseria meningitidis
MARSLYREANTWCIASLTLSKPLMFKKVSCCPANDASGRSSAVAEERTATEMSAPPASATILFHAASISASSCSGKGVSKIHWRISLPTRASSATSSTSNFASAAEMRSLRPLCARNAR

SEQ ID NO: 1359 - DNA, 360 bp, Neisseria meningitidis
atggcgcggtcgttgtacagggaggcgaatacatggcgcatcgcttctttaacgttttccaagccgttgatattcaggaaggtttcctgttggccggcaaatgatgcgtcgggcaggtcttcggcggttgcggaagagcgtacggcaacggaaatgtccgcgccgccggcatcggcaaccattttgttccatgccgcttcgatttcggcatcgagctgttcggggaagggcgtgtccaaaatccattggcggatttctttgccgacgcgtgccagttcggcaacgtcttcgacatctaattttgccagtgcggcggaaatgcgttcgctcagaccgttgtgtgcgaggaatgcgcggtag

SEQ ID NO: 1360 - protein, 119 aa, Neisseria meningitidis
MARSLYREANTWRIASLTFSKPLIFRKVSCWPANDASGRSSAVAEERTATEMSAPPASATILFHAASISASSCSGKGVSKIHWRISLPTRASSATSSTSNFASAAEMRSLRPLCARNAR

SEQ ID NO: 1361 - DNA, 1278 bp, Neisseria gonorrhoeae
atgttggttcaggacttgccttttgaagtcaaactgaaaaaattccatatcgatttttacaatacgggtatgccgcgcgattttgccagcgatattgaagtaacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgagggatgcttcgcgcgaacctgtcgtgttgaaggcaacctccatacaccagtttccgttggaaatcggcaaacacaaatatcgtcttgagttcgatcagttcacttctatgaatgtggaggacatgagcgagggtgcggaacgggaaaaaagcctgaaatccactctgaacgatgtccgcgccgttactcaggaaggtaaaaaatacaccaatatcggcccttccatcgtgtaccgcatccgtgatgcggcagggcaggcggtcgaatataaaaactatatgctgccgattttgcaggacaaagattatttttggctgaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaagacgcacctgccgaaatccgcgaacaattcatgctggctgcggaaaacacgctgaatatctttgcgcaaaaaggctatttgggattggacgaatttattacgtccaatatcccgaaagggcagcaggataagatgcagggctatttctacgaaatgctttacggcgtgatgaacgctgctttggatgaaaccatacgccggtacggcttgcccgaatggcagcaggatgaagcgcggaaccgtttcctgctgcacagtatggatgcctatacggggctgacggaatatcccgcgcctatgctgctccagcttgacgggttttccgaggtgcgttcctcaggtttgcagatgacccgttcgccgggtgcgcttttggtctatctcggctcggtattgttggttttgggtacagtatttatgttttatgtgcccaaaaaacgggcgtgggtattgttttcaaacdgcaaaatccgttttgctatgtcttcggcccgcagcgaacgggatttgcagaaggaatttccaaaacacgtcgagagcctgcaacggctcggcaaggacttgaatcatgactga

SEQ ID NO: 1362 - protein, 424 aa, Neisseria gonorrhoeae
MLVQDLPFEVKLKKFHIDFYNTGMPRDFASDIEVTDKATGEKLERTIRVNHPLTLHGITIYQASFADGGSDLTFKAWNLRDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPILQDKDYFWLTGTRSGLQQQYRWLRIPLDKQLKADTFMALREFLKDGEGRKRLVADATKDAPAEIREQFMLAAENTLNIFAQKGYLGLDEFITSNIPKGQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVFMFYVPKKRAWVLFSNKIRFAMSSARSERDLQKEFPKHVESLQRLGKDLNHD

SEQ ID NO: 1363 - DNA, 1274 bp, Neisseria meningitidis
atattggttcaggacttgccttttgaagtcaaactgaaaaaattccatatcgatttttacaatacgggtatgccgcgtgatttcgccagcgatattgaagtgacggacaaggcaaccggtgagaaactcgagcgcaccatccgcgtgaaccatcctttgaccttgcacggcatcacgatttatcaggcgagttttgccgacggcggttcggatttgacattcaaggcgtggaatttgggtgatgcttcgcgcgagcctgtcgtgttgaaggcaacatccatacaccagtttccgttggaaattggcaaacacaaatatcgtcttgagttcgatcagttcacttctatgaatgtggaggacatgagcgagggcgcggaacgggaaaaaagcctgaaatccacgctgmmcgatgtccgcgccgttactcaggaaggtaaaaaatacaccaatatcggcccttccattgtttaccgtatccgtgatgcggcagggcaggcggtcgaatataaaaactatatgctgccggttttgcaggaacaggattatttttggattaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaaggcgcacctgccgaaatccgcgaacaattcatgctggctgcggaaaacacgctgaacatctttgcacaaaaaggctatttgggattggacgaatttattacgtccaatatcccgaaagagcagcaggataagatgcagggctatttctacgaaatgctttacggcgtgatgaacgctgctttggatgaaaccatacgccggtacggcttgcccgaatggcagcaggatgaagcgcggaatcgtttcctgctgcacagtatggatgcgtacacgggtttgaccgaatatcccgcgcctatgctgctgcaacttgatgggttttccgaggtgcgttcgtcgggtttgcagatgacccgttccccgggtgcgcttttggtctatctcggctcggtgctgttggtattgggtacggtattgatgttttatgtgcgcgaaaaacgggcgtgggtattgttttcagacggcaaaatccgttttgccatgtcttcggcccgcagcgaacgggatttgcagaaggaatttccaaaacacgtcgagagtctgcaacggctcggcaaggacttgaatcatga

SEQ ID NO: 1364 - protein, 425 aa, Neisseria meningitidis
  misc_feature (136)..(136): Xaa can be any naturally occurring amino acid
ILVQDLPFEVKLKKFHIDFYNTGMPRDFASDIEVTDKATGEKLERTIRVNHPLTLHGITIYQASFADGGSDLTFKAWNLGDASREPVVLKATSIHQFPLEIGKHKYRLEFDQFTSMNVEDMSEGAEREKSLKSTLXDVRAVTQEGKKYTNIGPSIVYRIRDAAGQAVEYKNYMLPVLQEQDYFWITGTRSGLQQQYRWLRIPLDKQLKADTFMALREFLKDGEGRKRLVADATKGAPAEIREQFMLAAENTLNIFAQKGYLGLDEFITSNIPKEQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVLMFYVREKRAWVLFSDGKIRFAMSSARSERDLQKEFPKHVESLQRLGKDLNHD

SEQ ID NO: 1365 - DNA, 1278 bp, Neisseria meningitidis
atattggttcaggacttgccttttgaagtcaaactgaaaaaattccatatcgatttttacaatacgggtatgccgcgcgattttgccagtgatattgaagtaacggataaggcaaccggtgagaaactcgagcgcaccatccgcgtgaaccatcctttgaccttgcacggcatcacgatttatcaggcgagttttgccgacggcggttcggatttgacattcaaggcgtggaatttgggtgatgcttcgcgcgagcctgtcgtgttgaaggcaacatccatacaccagtttccgttggaaattggcaaacacaaatatcgtcttgagttcgatcagtttacttctatgaatgtggaggacatgagcgagggcgcggaacgggaaaaaagcctgaaatccacgctgaacgatgtccgcgccgttactcaggaaggtaaaaaatacaccaatatcggcccttccattgtttaccgtatccgtgatgcggcagggcaggcggtcgaatataaaaactatatgctgccggttttgcaggaacaggattatttttggattaccggcacgcgcagcggcttgcagcagcaataccgctggctgcgtatccccttggacaagcagttgaaagcggacacctttatggcattgcgtgagtttttgaaagatggggaagggcgcaaacgtctggttgccgacgcaaccaaaggcgcacctgccgaaatccgcgaacaattcatgctggctgcggaaaacacgctgaacatctttgcacaaaaaggctatttgggattggacgaatttattacgtccaatatcccgaaagagcagcaggataagatgcagggctatttctacgaaatgctttacggcgtgatgaacgctgctttggatgaaaccatacgccggtacggcttgcccgaatggcagcaggatgaagcgcggaatcgtttcctgctgcacagtatggatgcgtacacgggtttgaccgaatatcccgcgcctatgctgctgcaacttgatgggttttccgaggtgcgttcgtcgggtttgcagatgacccgttccccgggtgcgcttttggtctatctcggctcggtgctgttggtattgggtacggtattgatgttttatgtgcgcgaaaaacgggcgtgggtattgttttcagacggcaaaatccgttttgccatgtcttcggcccgcagcgaacgggatttgcagaaggaatttccaaaacacgtcgagagtctgcaacggctcggcaaggacttgaatcatgactga

SEQ ID NO: 1366 - protein, 425 aa, Neisseria meningitidis
ILVQDLPFEVKLKKFHIDFYNTGMPRDFASDIEVTDKATGEKLERTIRVNHPLTLHGITIYQASFADGGSDLTFKAWNLGDASREPVVLKATSIHQFPLEIGKHKYRLEFDQFTSMNVEDMSEGAEREKSLKSTLNDVRAVTQEGKKYTNIGPSIVYRIRDAAGQAVEYKNYMLPVLQEQDYFWITGTRSGLQQQYRWLRIPLDKQLKADTFMALREFLKDGEGRKRLVADATKGAPAEIREQFMLAAENTLNIFAQKGYLGLDEFITSNIPKEQQDKMQGYFYEMLYGVMNAALDETIRRYGLPEWQQDEARNRFLLHSMDAYTGLTEYPAPMLLQLDGFSEVRSSGLQMTRSPGALLVYLGSVLLVLGTVLMFYVREKRAWVLFSDGKIRFAMSSARSERDLQKEFPKHVESLQRLGKDLNHD

SEQ ID NO: 1367 - DNA, 894 bp, Neisseria gonorrhoeae
atgtttcgtttacaattcaggctgtttccccctttgcgaaccgccatgcacatcctgttgaccgccctgctcaaatgcctctccctgctgtcgctttcctgtctgcacacgctgggaaaccggctcggacatctggcgttttaccttttaaaggaagaccgcgcgcgcatcgtcgccaatatgcggcaggcgggtttgaaccccgacacgcagacggtcaaagccgtttttgcggaaacggcaaaatgcggtttggaacttgcccccgcgtttttcaaaaaaccggaagacatcgaaacaatgttcaaagcggtacacggctgggaacacgtgcagcaggctttggacaagggcgaagggctgctgttcatcacgccgcacatcggcagctacgatttgggcggacgctacatcagccagcagcttccgttccacctgaccgccatgtacaagccgccgaaaatcaaagcgatagacaaaatcatgcaggcgggcagggtgcgcggcaaaggcaaaaccgcgcccaccggcatacaaggggtcaaacaaatcatcaaggccctgcgcgcgggcgaggcaaccatcatcctgcccgaccacgtcccttctccgcaggaaggcggcggcgtgtgggcggattttttcggcaaacctgcatacaccatgacactggcggcaaaattggcacacgtcaaaggcgtgaaaaccctgtttttctgctgcgaacgcctgcccgacggacaaggcttcgtgttgcacatccgccccgtccaaggggaattgaacggcaacaaagcccacgatgccgccgtgttcaaccgcaataccgaatattggatacgccgttttccgacgcagtatctgtttatgtacaaccgctataaaacgccgtaa

SEQ ID NO: 1368 - protein, 297 aa, Neisseria gonorrhoeae
MFRLQFRLFPPLRTAMHILLTALLKCLSLLSLSCLHTLGNRLGHLAFYLLKEDRARIVANMRQAGLNPDTQTVKAVFAETAKCGLELAPAFFKKPEDIETMFKAVHGWEHVQQALDKGEGLLFITPHIGSYDLGGRYISQQLPFHLTAMYKPPKIKAIDKIMQAGRVRGKGKTAPTGIQGVKQIIKALRAGEATIILPDHVPSPQEGGGVWADFFGKPAYTMTLAAKLAHVKGVKTLFFCCERLPDGQGFVLHIRPVQGELNGNKAHDAAVFNRNTEYWIRRFPTQYLFMYNRYKTP

SEQ ID NO: 1369 - DNA, 866 bp, Neisseria meningitidis
ggcatgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcggcaggcgggtttgaaccccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgagcaaccatcgtcctgcccgaccacgtcccctcccctcaagaaggcggggaaggcgtatgggtggatttcttcggcaaacctgcctataccatgacgctggcggcaarattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcatatc

SEQ ID NO: 1370 - protein, 288 aa, Neisseria meningitidis
  misc_feature (228)..(228): Xaa can be any naturally occurring amino acid
MFRLQFRLFPPLRTAMHILLTALLKCLSLLPLSCLHTLGNRLGHLAFYLLKEDRARIVANMRQAGLNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAXLAHVKGVKTLFFCCERLPGGQGFDLHIRPVQGELNGDKAHDAAVFNRNAEYWIRRFPTHI

SEQ ID NO: 1371 - DNA, 897 bp, Neisseria meningitidis
atgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcgtcaggcaggcatgaatcccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgaagcaaccatcgtcctgcccgaccacgtcccctcccctcaagaaggcggggaaggcgtatgggtggatttcttcggcaaacctgcctataccatgacgctggcggcaaaattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcagtatctgtttatgtacaaccgctacaaaatgccgtaa

SEQ ID NO: 1372 - protein, 298 aa, Neisseria meningitidis
MFRLQFRLFPPLRTAMHILLTALLKCLSLLPLSCLHTLGNRLGHLAFYLLKEDRARIVANMRQAGMNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAKLAHVKGVKTLFFCCERLPGGQGFDLHIRPVQGELNGDKAHDAAVFNRNAEYWIRRFPTQYLFMYNRYKMP

SEQ ID NO: 1373 - DNA, 897 bp, Neisseria meningitidis
atgtttcgtttacaattcaggctgtttccccctttgcgaaccgccatgcacatcctgttgaccgccctgctcaaatgcctctccctgctgccgctttcctgtctgcacacgctgggaaaccggctcggacatctggcgttttaccttttaaaggaagaccgcgcgcgcatcgtcgccaatatgcggcaggcgggtttgaaccccgaccccaaaacggtcaaagccgtttttgcggaaacggcaaaaggcggtttggaacttgcccccgcgtttttcagaaaaccggaagacatagaaacaatgttcaaagcggtacacggctgggaacatgtgcagcaggctttggacaaacacgaagggctgctattcatcacgccgcacatcggcagctacgatttgggcggacgctacatcagccagcagcttccgttcccgctgaccgccatgtacaaaccgccgaaaatcaaagcgatagacaaaatcatgcaggcgggcagggttcgcggcaaaggaaaaaccgcgcctaccagcatacaaggggtcaaacaaatcatcaaagccctgcgttcgggcgaagcaaccatcgtcctgcccgaccacgtcccctcccctcaagaaggcggggaaggcgtatgggtggatttcttcggcaaacctgcctataccatgacgctggcggcaaaattggcacacgtcaaaggcgtgaaaaccctgtttttctgctgcgaacgcctgcctggcggacaaggtttcgatttgcacatccgccccgtccaaggggaattgaacggcgacaaagcccatgatgccgccgtgttcaaccgcaatgccgaatattggatacgccgttttccgacgcagtatctgtttatgtacaaccgctacaaaatgccgtaa

SEQ ID NO: 1374 - protein, 298 aa, Neisseria meningitidis
MFRLQFRLFPPLRTAMHILLTALLKCLSLLPLSCLHTLGNRLGHLAFYLLKEDRARIVANMRQAGLNPDPKTVKAVFAETAKGGLELAPAFFRKPEDIETMFKAVHGWEHVQQALDKHEGLLFITPHIGSYDLGGRYISQQLPFPLTAMYKPPKIKAIDKIMQAGRVRGKGKTAPTSIQGVKQIIKALRSGEATIVLPDHVPSPQEGGEGVWVDFFGKPAYTMTLAAKLAHVKGVKTLFFCCERLPGGQGFDLHIRPVQGELNGDKAHDAAVFNRNAEYWIRRFPTQYLFMYNRYKMP

SEQ ID NO: 1375 - DNA, 1563 bp, Neisseria gonorrhoeae
atggcggtatttgatgaagtcgggcgcatcgcccatggctgcggcggtgttgtcaaacaaagcctgtttctgcgcgtcgttcatcaggttgaacaaggcgcgcggttggctgaagtagtcgtcatcgtcttggcggtagtcccagtgtgccgcgtcgccgttgattttcaaaggcggttcggcgaagtcgggttgttgctgccattggccgaagctgttgggttcgtagtgcggcaggctgccgtagttgccgtcggcgcggccttgtccgtcgcgctggttgctgtgaacagggcaacgcggacgattgacggggatttggcggaagttcacacccaagcggtaacgttgcgcgtcggcgtaattgaacaaacgggcttgcaacattttatccgggctcgcgccgataccgggaacgaggttgctcggtgcgaaggcggattgttccacatcggcgaagaagttttcgggattgcggttcaactcgaattcgcccacttcaatcagcggatagtcttttttcggccaaactttggtcaagtcaaacggatgataaggcactttttcggcatcggcttcaggcatgacttggatgtacatcgtccatttcgggaactcgccgcgctcgatggcttcgtacaggtcgcgctgatggctttcgcggtcgtcggcgatgatttttgcagcttcttcgttggtcaggtttttaatcccttgctggctgcggaaatggaatttcacccaaaaacgttcgcccgcttcgttccagaagctgtaggtatgcgaaccgaagccgtgcatatggcggtagctggcgggaataccgcggtcgctcatcacgatggtaacttggtgcagggcttcgggcagcagcgtccagaagtcccagttgtttgtggcggaacgcatattggtgcgcggatcgcgtttgacggctttgttcaggtcggggaatttgcgcgggtcgcgcaggaagaacacgggcgtgttgttgccgaccacatcccagttgccttcttcggtatagaatttcaacgcaaaaccgcggatgtcgcgttccgcatcggctgcgccgcgctcgcctgccacggtggtgaaacgggcgaacatctcggtttttttgccgacttcgctgaaaattttggcgcgggtgtatttggtgatgtcgtgtgttacggtaaacgtaccgaacgcgcccgaacctttggcgtgcatacggcgttcggggatgacttcgcgcacgaagtcggcgagtttttcattcagccacaaatcttgcgtcagcagggggccgcgcgggccggcggtcaggctgttttgattgtcggcaacgggcgcgccgttgttcatggtcagatgggttacggggcatttggaggtagtcatcgctcttgttccttttctcaggttggtcaaatggggggcaaacggcttacagtacgatttggcggaaagcgtattcgtaaccggtttcttgattgtaataaatttcttgaatcgacattttattttccttttgcaaaaactatggatgcgattatacgccaagattttcgttattaa

SEQ ID NO: 1376 - protein, 520 aa, Neisseria gonorrhoeae
MAVFDEVGRIAHGCGGVVKQSLFLRVVHQVEQGARLAEVVVIVLAVVPVCRVAVDFQRRFGEVGLLLPLAEAVGFVVRQAAVVAVGAALSVALVAVNRATRTIDGDLAEVHTQAVTLRVGVIEQTGLQHFIRARADTGNEVARCEGGLFHIGEEVFGIAVQLEFAHFNQRIVFFRPNFGQVKRMIRHFFGIGFRHDLDVHRPFRELAALDGFVQVALMAFAVVGDDFCSFFVGQVFNPLLAAEMEFHPKTFARFVPEAVGMRTEAVHMAVAGGNTAVAHHDGNLVQGFGQQRPEVPVVCGGTHIGARIAFDGFVQVGEFARVAQEEHGRVVADHIPVAFFGIEFQRKTADVAFRIGCAALACHGGETGEHLGFFADFAENFGAGVFGDVVCYGKRTERARTFGVHTAFGDDFAHEVGEFFIQPQILRQQGAARAGGQAVLIVGNGRAVVHGQMGYGAFGGSHRSCSFSQVGQMGGKRLTVRFGGKRIRNRFLDCNKFLESTFYFPFAKTMDAIIRQDFRY

SEQ ID NO: 1377 - DNA, 1322 bp, Neisseria meningitidis
atggcggtatttgatgaagtcgggcgcgtcgcccattgcggcggcggtgttgccgaacaatgcctgtttctgcgcgtcgttcatcaggttgaacagggcgcgcggttggctgaaatagtcgtcatcgtcttggcggtagtcccagtgtgccgcgtcgccgttgattttcaaaggcggttcggcgaatcggggttgttgctgccattggccgaagctgtygggttcgtagtgcggcaggctgccgyagttgccgtcggcgcggccttgcccgtygcgstgrttgctgtgaacasggcaacgcggacgattgacgggaatttggcggaagtttacgcccaaacggtagcgttgtgcgtcggcgtaattgaacaaacgcgcttgcagcattttatctsggctggcgccgacaccgggaacgaggttgctcggtgcgaaggcggattgttccacatcggcgaagaagttttcgggattgcggttctcaaacggatgataaggtactttttccgcgtctgcttcaggcatgacttggatgtacatcgtccatttcggaaactcgccgcgttcgatggcttcstataagtcgcgctgatggctttcgcggtcgtcggcgatgattttggcggcttcttcgttggtcaggtttttaatgccttgttgggtgcggaaatggaatttcacccaaaaacgctcgcctgcttcgttccagaagctgtaggtatgcgaaccgaagccgtgcatatggcggtagccggcggggatgccgcggtcgctcatcacgatggtaacttggtgcagtgcttcgggcagcagcgtccagaagtcccagttgtttgtggcagagcgcatattggtgcgcgggtcgcgtttgacggctttgttcaggtcggggaacttacgcgggtcgcgcaggaagaacacgggcgtgttgttgccgaccacatcccagttgccttcttcggtataaaatttcaaggcaaaaccgcggatgtcgcgttctgcatcggctgcgccgcgttcgcctgccacggtggtgaaacgggcgaacatctcggtttttttgccgacttcgctgaagattcctttggcgtgcatacggcgttcggggatgacttcgcgcacgaagtcggcgagtttttcagtcatcgctcttgttccttttctcaggttggtcaaatgggggtaaacggcttacagtacgatttggcggaaagcgtattcgtaaccggtttcttgattgcaataaatttcttgaatcgacattttatttcccttttgtaaaaactatggatgcgactatacgccaagattttcgctattaa

SEQ ID NO: 1378 - protein, 520 aa, Neisseria meningitidis
  misc_feature (82)..(82): Xaa can be any naturally occurring amino acid
  misc_feature (93)..(94): Xaa can be any naturally occurring amino acid
  misc_feature (98)..(98): Xaa can be any naturally occurring amino acid
  misc_feature (132)..(132): Xaa can be any naturally occurring amino acid
  misc_feature (213)..(214): Xaa can be any naturally occurring amino acid
MAVFDEVGRVAHCGGGVAEQCLFLRVVHQVEQGARLAEIVVIVLAVVPVCRVAVDFQRRFGESGLLLPLAEAVGFVVRQAAXVAVGAALPVAXXAVNXATRTIDGNLAEVYAQTVALCVGVIEQTRLQHFIXAGADTGNEVARCEGGLFHIGEEVFGIAVQLEFAHFNQRIVFFRPNFGQVKRMIRYFFRVCFRHDLDVHRPFRKLAAFDGFXXVALMAFAVVGDDFGGFFVGQVFNALLGAEMEFHPKTLACFVPEAVGMRTEAVHMAVAGGDAAVAHHDGNLVQCFGQQRPEVPVVCGRAHIGARVAFDGFVQVGELTRVAQEEHGRVVADHIPVAFFGIKFQGKTADVAFCIGCAAFACHGGETGEHLGFFADFAEDFGAGVFGDVVRYGKRTERARTFGVHTAFGDDFAHEVGEFFIQPQILRQQRAARTGGQAVLIVGNRRAVVHGQMGYRAFGGSHRSCSFSQVGQMGGKRLTVRFGGKRIRNRFLDCNKFLESTFYFPFVKTMDATIRQDFRY

SEQ ID NO: 1379 - DNA, 1562 bp, Neisseria meningitidis
  misc_feature (1382)..(1382): n is a, c, g, or t
atggcggtatttgatgaagtcgggcgcgtcgcccattgcggcggcggtgttgccgaacaatgcctgtttctgcgcgtcgttcatcaggttgaacagggcgcgcggttggctgaaatagtcgtcatcgtcttggcggtagtcccagtgcgccgcgtcgccgttgattttcaaaggcggttcggcgaagtcgggctgctgctgccattggccgaagctgttgggttcgtagtgcggcaggctgccgtagttgccgtcggcgcgtccttgtccgtcgcgctggttgctgtgaacagggcaacgcggacggttgacagggatttggcggaagttcacgcccaagcggtagcgttgcgcgtcggcgtaattgaacaaacgcgcctgcaacattttatctgggctggcgccgacaccgggaacgaggttgctcggtgcgaaggcggattgttccacatcggcgaagaagttttcgggattgcggttcaactcgaattcgcccacttcaatcagcggatagtcttttttcggccaaactttggtcaagtcaaacggatgatacggcactttttccgcatcggcttcaggcatgacttggatgtacatcgtccatttcggaaactcgccgcgctcgatggcttcgtacaggtcgcgctgatggctttcacggtcgtcggcgatgattttggcggcttcttcgttggtcaggtttttaatgccttgttgggtgcggaaatggaatttcacccaaaaacgctcgcctgcttcgttccagaagctgtaggtatgcgaaccgaagccgtgcatatggcggtagccggcggggatgccgcggtcgctcatcacgatggtaacttggtgcagtgcttcgggcagcagcgtccagaagtcccagttgtttgtggcagagcgcatattggtgcgcgggtcgcgtttgacggctttgttcaggtcggggaacttacgcgggtcgcgcaggaagaacacgggcgtgttgttgccgaccacatcccagttgccttcttcggtatagaacttcaacgcaaaaccgcggatgtcgcgttctgcatcggctgcgccgcgttcgcctgccacggtggtgaaacgggcgaacatctcggtttttttgccgacttcgctgaagattttggcgcgggtgtatttggtgatgtcgtgcgttacggtaaacgtaccgaacgcgcccgaacctttggcgtgcatacggcgttcggggatgacttcgcgcacgaagtcggcgagtttttcattcagccacaaatcctgcgccagcagagggccgcgaggaccggcggtcaggctgttttgattgtcggcaacaggcgcgccgttgttcatggtcagatgggttacagggcatttggaggtantcatcgctcttgttccttttctcaggttggtcaaatgggggtaaacggcttacagtacgatttggcggaaagcgtattcgtaaccggtttcttgattgcaataaatttcttgaatcgacattttatttcccttttgtaaaaactatggatgcgactatacgccaagattttcgctattaa

SEQ ID NO: 1380 - protein, 520 aa, Neisseria meningitidis
  misc_feature (461)..(461): Xaa can be any naturally occurring amino acid
  misc_feature (473)..(473): Xaa can be any naturally occurring amino acid
MAVFDEVGRVAHCGGGVAEQCLFLRVVHQVEQGARLAEIVVIVLAVVPVRRVAVDFQRRFGEVGLLLPLAEAVGFVVRQAAVVAVGASLSVALVAVNRATRTVDRDLAEVHAQAVALRVGVIEQTRLQHFIWAGADTGNEVARCEGGLFHIGEEVFGIAVQLEFAHFNQRIVFFRPNFGQVKRMIRHFFRIGFRHDLDVHRPFRKLAALDGFVQVALMAFTVVGDDFGGFFVGQVFNALLGAEMEFHPKTLACFVPEAVGMRTEAVHMAVAGGDAAVAHHDGNLVQCFGQQRPEVPVVCGRAHIGARVAFDGFVQVGELTRVAQEEHGRVVADHIPVAFFGIELQRKTADVAFCIGCAAFACHGGETGEHLGFFADFAEDFGAGVFGDVVRYGKRTERARTFGVHTAFGDDFAHEVGEFFIQPQILRQQRAARTGGQAVLIVGNRRAVVHGQMGYRAFGGXHRSCSFSQVGQXGGKRLTVRFGGKRIRNRFLDCNKFLESTFYFPFVKTMDATIRQDFRY

SEQ ID NO: 1381 - DNA, 558 bp, Neisseria gonorrhoeae
atgctcttgccggctttgcaacaaggcggcggcttcctgagcggcggcggtttcggcctcgtcgggcaggttcagggcttggttttcctgcttcagacggcctttgcgctcttcgtgcttggcaacggtttgttcggcatgggcaagctgctgctgcttcaacgccagttcgcggcggatgcggtttgcctcgtcctgctgggtttggaaggcagcgttgagcgtggcttggacttcttccaattcgggcagacgctcttcgtgttcggcaacctgcatcgcccattccgccaattcggtttgcttttcttcgacctgcaactcgttttcctcaagctgcacgcggatttgctgctgctcctgccggatgcgttgcaactgcgcctgcgctgcctgcttgtcgcgttcgatgcgttggtgcaggttttgccggtggcggatttgttcttccaaacgggcaatctgctcgcgcaacacgccgcgtttgttgctcaattcgtgtactgcctgctgctgcgactgttcggcagtctgcaaggcgtgtacttcgttatttaa

SEQ ID NO: 1382 - protein, 185 aa, Neisseria gonorrhoeae
MLLPALQQGGGFLSGGGFGLVGQVQGLVFLLQTAFALFVLGNGLFGMGKLLLLQRQFAADAVCLVLLGLEGSVERGLDFFQFGQTLFVFGNLHRPFRQFGLLFFDLQLVFLKLHADLLLLLPDALQLRLRCLLVAFDALVQVLPVADLFFQTGNLLAQHAAFVAQFVYCLLLRLFGSLQGVYFVI

SEQ ID NO: 1383 - DNA, 558 bp, Neisseria meningitidis
atgctcttgctgactttgcaacaaggcggctgcttcctgcgcggcggcggtttcggcttcgtcgggcaggtttaaggcttggttttcctgtttcagacgacctttgcgctcttcgtgcttggcaatcgtttgttcggcatgggcaagctgctgctgcttcaacgccagttcgcggcggatgcggtttgcctcgtcctgctgggtttggaaggcggcgttgagcgtggcttgggcttcttccaattcgggcagacgctcctcgtgttcggcaacctgcatcgcccattccgccagctcggtttgtttttcttcgacctgcaactcgttttcttcaagctgcacgcggatttgctgctgctcttgatgaatgcgttgtaactgcgcctgcgctgcctgcttgtcgcgttcgatgcgttggtgcaggttttgctgatggcggatttgttcttccaaacgggcaatctgctcgcgcaacacgccgcgcttgttgctcaattcatgcactgcctgctgctgcgactgttcggcagtctgcaaggcgtgtacttcgtcgtttaa

SEQ ID NO: 1384 - protein, 185 aa, Neisseria meningitidis
  misc_feature (25)..(25): Xaa can be any naturally occurring amino acid
  misc_feature (126)..(126): Xaa can be any naturally occurring amino acid
MLLLTLQQGGCFLRGGGFGFVGQVXGLVFLFQTTFALFVLGNRLFGMGKLLLLQRQFAADAVCLVLLGLEGGVERGLGFFQFGQTLLVFGNLHRPFRQLGLFFFDLQLVFFKLHADLLLLLMNALXLRLRCLLVAFDALVQVLLMADLFFQTGNLLAQHAALVAQFMHCLLLRLFGSLQGVYFVV

SEQ ID NO: 1385 - DNA, 558 bp, Neisseria meningitidis
atgctcttgctggctttgcaacaaggcggcagcttcctgcgcggcggcggtttcggcttcgtcaggcagattcagggcttggttttcctgtttcagacgacctttgcgctcttcgtgcttggcaacggtttgttcggcatgggcaagctgctgctgcttcaacgccagttcgcggcggatgcggtttgcctcgtcctgctgggtttggaaggcggcattgagtgtggcttgggtttcttccaattcgggcagacgctcttcgtgttcggcaacctgcatcgcccattccgccaattcggtttgcttttcttccgcctgcaactcgttttcttcaagctgcacgcggatttgctgctgctcctgatggatgcgctgcatctgcgcctgcgccgcctgcttgtcgcgttcgatgcgttggtgcaggttttgctgatggcggatttgttcttccaaacgggcaatctgttcgcgcaacacgccgcgtttgttgcccaattcgtgcaccgcctgctgctgcgactgttcggcagtctgcaaggcgtgtacttcgtcgtttaa

SEQ ID NO: 1386 - protein, 185 aa, Neisseria meningitidis
MLLLALQQGGSFLRGGGFGFVRQIQGLVFLFQTTFALFVLGNGLFGMGKLLLLQRQFAADAVCLVLLGLEGGIECGLGFFQFGQTLFVFGNLHRPFRQFGLLFFRLQLVFFKLHADLLLLLMDALHLRLRRLLVAFDALVQVLLMADLFFQTGNLFAQHAAFVAQFVHRLLLRLFGSLQGVYFVV

SEQ ID NO: 1387 - DNA, 504 bp, Neisseria gonorrhoeae
atggtagcgtttggcgttgatcagggcctcctgctgctgcaacagggcggtttgggtggcggcctgaagctgcggcagcttggtttgcagggtttgtacgcgggcgtattgctccctgccctgttcctgaatctgcgcgagtttttcctgcacggcgatgtattcttcgtccagcgtgtgtacggtttcggtcaactcgtcgagcttgatgtgctgctcgtcgttttggaactcggtttcataggcgagggcaagctcttgccggcgttcctgccagtccagggtttgctgttcgagccgggcgatttgctgccggtagttttgtttttgcgggttgagtttgtggacggcgacttcggcaagcccgtattggcggttggcttccaacagggcaagctgcgcctgtttcagacggccttgctgctcttggcggctgtgcgcggtggtttgctgctggtgttcgagttcggcggcggcttcctgcaaagtagcgatgtcgtctga

SEQ ID NO: 1388 - protein, 167 aa, Neisseria gonorrhoeae
MVAFGVDQGLLLLQQGGLGGGLKLRQLGLQGLYAGVLLPALFLNLREFFLHGDVFFVQRVYGFGQLVELDVLLVVLELGFIGEGKLLPAFLPVQGLLFEPGDLLPVVLFLRVEFVDGDFGKPVLAVGFQQGKLRLFQTALLLLAAVRGGLLLVFEFGGGFLQSSDVV

SEQ ID NO: 1389 - DNA, 504 bp, Neisseria meningitidis
atggtagcgtttggcgttgatcagggcttcctgctgctgcaacaaggcggtttgggtggcggcctgaagctgcggcagcttggtttgcagggtttgcactttagcgtattgctccctgccctgttcctgaatctgcgcgagtttctcttgcacaacaatatattcttcgtccaaggtctgtacggcttcgcttaattcttcaagcttgatgtgctgctcgtcgttttggaactcggtttcataggcgagggcaagctcttgctggcgttcctgccagtcgagggtttgctgttcaagctgggcgatttgctgccggtagttttgtttttgctggttgagtttgtggacggcgacttcggcaagcccgtattggcggttggcttccaacagggcaagctgcgcctgtttcagacggccttgctgctcttggcggctgtgcgcggtggtttgctgctggtgttcgagttcggcggcggcttcctgcaaggtaacgatgtcgtctga

SEQ ID NO: 1390 - protein, 167 aa, Neisseria meningitidis
  misc_feature (65)..(65): Xaa can be any naturally occurring amino acid
MVAFGVDQGFLLLQQGGLGGGLKLRQLGLQGLHFSVLLPALFLNLREFLLHNNIFFVQGLYGFAXFFKLDVLLVVLELGFIGEGKLLLAFLPVEGLLFKLGDLLPVVLFLLVEFVDGDFGKPVLAVGFQQGKLRLFQTALLLLAAVRGGLLLVFEFGGGFLQGNDVV

SEQ ID NO: 1391 - DNA, 504 bp, Neisseria meningitidis
atggtagcgtttggcgttgatcagggcttcctgctgctgcaacagggcggtttgggtggcggcctgaagctgcggcagcttggtttgcagggtttgtacgcgggcgtattgttccctaccctgctcctgaatctgcgcgagtttctcctgtacgacaatatattcttcgtccaaactctgtacggcttcgctcaactcttcgagcttgatgtgctgctcgtcgttttggaactcggtttcataggcgagggcaagctcttgctggcgttcctgccaatcgaaggtttgttgttcaagctgggcaatttgctgttggtagttttgtttttgctggttgagcttgtggacggcgacttcggcaagcccgtattggcggttggcttccaacagggcaagctgcgcctgtttcagacgaccttgctgctcttggcggctgtgcgcggcggtttgctgctggtgttcgagttcggcggcggcttcctgcaaaatggcgatgtcgtctga

SEQ ID NO: 1392 - protein, 167 aa, Neisseria meningitidis
MVAFGVDQGFLLLQQGGLGGGLKLRQLGLQGLYAGVLFPTLLLNLREFLLYDNIFFVQTLYGFAQLFELDVLLVVLELGFIGEGKLLLAFLPIEGLLFKLGNLLLVVLFLLVELVDGDFGKPVLAVGFQQGKLRLFQTTLLLLAAVRGGLLLVFEFGGGFLQNGDVV

SEQ ID NO: 1393 - DNA, 1725 bp, Neisseria gonorrhoeae
atggtcgctgtatgtgatgaacgggctgtacagcggacgttggtggcccaattcgcgcaacaaggcggcttgtttttgctcttcgttcaggctgttgtagtcttccaagcctgcgtgttggaaaagctcggcaaccacatcggcgtgtttgcctgcgtgttggcgcaggtcgagcggcatcatgtggaagccgaacacggacacggaacggatgaggtctgccaaacggccttcggcaagcaggcggctgccgttgtcgataagggaacgttgcaattttttcaaatcatcgagaaatttttgggccgaagcataaggctcgagaaagccgaatttgcagcccatgcccaaaccgagcgagcgcgctttgcccatagcgcgcgccataatgtaggcaatggcgcggcggtaaggttcttcggtgcgggcgatttcttcgtcaggcgagagggctgccagtgccattacgtcgtcgttgactttgacgcggcggatggaaagcggcagttcgcggtaaagtttgtcgagttcgctgcggtaaaaacggaacacggcatcggcgtggcggcggaaggcaaagcgcagggtttcgccagaaacaaacggattgccgtcgcggtcgccgccgatccagccgccgattttaaggatattcggaacgcggacatcgggataggccgtctgaaagtcgtgttccatcttgcggtagagtttgggcagggcttcaaaaaagctcatcgggaagatggacacgccgttgttgatttcgtcgttgacgctgagtttgtggcggcgcgtttcgctggtctgccacaagcccagaagcacggtgtcgatttcgcggcgcagccgtgccagcgcgtcggcattggtgcagcgttcgcgttgcggcagcagcgcgcggatgcggcggttgaaattcaaaacggtttggcgttgcacttcggtcgggtgcgcggtcaaaacggcggtaacggacgtattgtccaactgccgctgcaccgatttgccgtcggctttccccgctttgagcctgcggacggtttccgtcaggctgccttctgctgcgttgtggccggcatcttcgtggatttggcggcggcgttcgtggtgcacgtcttcggcgatattcagaatctgggcgaacagcccgcaggcaagcgtcagatcgtaggtctgccgttcgtccaattgcggcaatactttttcaatcaatgccgcgctgtcgtcggaagtggacaagagtttgaccgtttcgacaaccaacggcgaggcttcttcgtgcaggaggttgaacagggactgtttcaaaaattccgcgtccgccgccaaagccgcgtccttcggattgttcaggatatgcagttgcatgattttcctctcattgccgtaaatactgtaaatgtacctcaaatgccgcatccgtgccaaaccgttcacactttaaccactcatgtcccgaaatgccgtctgaagttgaacgccgcccgacggcggcgttacaatcgcccgcaactgtttttttccgaacatcatcatgaccgcgaccgaacacgacaacgacgacgcactcctgctgcggtacagccgccacatcctcttggacgaaatcggcatcgaagggcagcagaagctttccgccgcgcatattttggtcgtcggctgcggcggattgggcgccgccgcccctgccctatctcgccgcctcgggggtcggcacgctga

SEQ ID NO: 1394 - protein, 574 aa, Neisseria gonorrhoeae
MVAVCDERAVQRTLVAQFAQQGGLFLLFVQAVVVFQACVLEKLGNHIGVFACVLAQVERHHVEAEHGHGTDEVCQTAFGKQAAAVVDKGTLQFFQIIEKFLGRSIRLEKAEFAAHAQTERARFAHSARHNVGNGAAVRFFGAGDFFVRREGCQCHYVVVDFDAADGKRQFAVKFVEFAAVKTEHGIGVAAEGKAQGFARNKRIAVAVAADPAADFKDIRNADIGIGRLKVVFHLAVEFGQGFKKAHREDGHAVVDFVVDAEFVAARFAGLPQAQKHGVDFAAQPCQRVGIGAAFALRQQRADAAVEIQNGLALHFGRVRGQNGGNGRIVQLPLHRFAVGFPRFEPADGFRQAAFCCVVAGIFVDLAAAFVVHVFGDIQNLGEQPAGKRQIVGLPFVQLRQYFFNQCRAVVGSGQEFDRFDNQRRGFFVQEVEQGLFQKFRVRRQSRVLRIVQDMQLHDFPLIAVNTVNVPQMPHPCQTVHTLTTHVPKCRLKLNAARRRRYNRPQLFFSEHHHDRDRTRQRRRTPAAVQPPHPLGRNRHRRAAEAFRRAYFGRRLRRIGRRRPCPISPPRGSAR

SEQ ID NO: 1395 - DNA, 1727 bp, Neisseria meningitidis
atggtcgctgtatgtgataaacgggctgtacagaggacgttgatggctcaattcgcgcaacagggcggtttgtttttgctcttcgttcaggcggttgtagtcttccaagcctgcgtgttggaaaagctcggcaaccacatcggcgtgtttgcctgcgtgttggcgcaagtcgagcggcatcatgtgaaagccgaacacggatacggaacggatgaggtctgccaaacggccttcggcaagcagacggctgccgttgtcgataagggaacgttgcaattttttcaaatcatccagaaactcttgtgccgaagcataaggctcgagaaagccgaatttgcagcccatacccaaaccgagcgcgcgcgctttgcccatagcgcgcgccataatgtaggcgatggcgcggcggtagggttcttcggcgcgggcgatttcttcgtcgggcgatttgtcggacaacgccgttacatcgccgttgactttgacgcggcggatggagagcggcagttcgcggtagagtttgtcgagttcgccgcgatagaagcggaacacggcatcggcgtggcggcggaaggcaaagcgcagggtttcggcagaaacaaacggattgccgtcgcggtcgccgccgatccagccgccgattttgaggatgtccggaacgcggacgccgggataggccgtctgaaagtcgtgttccatcttgcggtagagcttgggcagggcttcgaaaaagctcatcgggaagatggacacgccgttgttgatttcgtcgttgacgctgagtttgtggcggcgcgtttcgctggtctgccacaagcccagcaggatagtgtcgatttcgcggcgcagccgtgccagcgcgtcggcattggtgcagcgttcgcgttgcggcaacagtgcgcggatgcggcggttgaagcttaagacggtttggcgttgcacttcggtcgggtgcgcggtcaaaacggcggtaacggacgtattgtccaactgccgctgcaccgatttgccgtcggctttccccgctttgagcctgcggacggtttccgtcaggctgccttccgcgccgccgcgtccggcttcttcgtggatttggcggcggcgttcgtggtgcacgtcttcggcgatgttcaaaatctgggcgaacaggccgcaggccaaggttaaatcgtgggtttgttgttcgtccaattgcggcaatactttttcaatcaatgccgcgctgtcgtcggaagtggacaagagtttgactgtttcgacaaccaacggcgaggcttcttcgtgcaggaggttgaacagggattgtttcagaaattccgcgtccgccgccaaagccgcgtcctttggattgttcagaatatgcagttgcatgatttttctctctcgtctgccgtaaatattgtaaatgtaccccaaatgccgcatccgtgccaaaccgttcacactttaaccgcccgtgtcccgaaatgccgtctgaagttgaacgccgcccgacggcagcgttacaatcgcccgcaactgtttttttccgaacatcatcatgaccacgaccgaacacgacaacgacgatgcattcctgctgcggtacagccgccacatcctcttggacgaaatcggcatcgaagggcagcagaaactttccgccgcgcatattttggtcgtcggctgcggcggtttgggtgccgccgcactgccctaccttgccgcttcgggtgtcggcacgctga

SEQ ID NO: 1396 - protein, 575 aa, Neisseria meningitidis
  misc_feature (308)..(308): Xaa can be any naturally occurring amino acid
  misc_feature (389)..(389): Xaa can be any naturally occurring amino acid
  misc_feature (565)..(565): Xaa can be any naturally occurring amino acid
MVAVCDKRAVQRTLMAQFAQQGGLFLLFVQAVVVFQACVLEKLGNHIGVFACVLAQVERHHVKAEHGYGTDEVCQTAFGKQTAAVVDKGTLQFFQIIQKLLCRSIRLEKAEFAAHTQTERARFAHSARHNVGDGAAVGFFGAGDFFVGRFVGQRRYIAVDFDAADGERQFAVEFVEFAAIEAEHGIGVAAEGKAQGFGRNKRIAVAVAADPAADFEDVRNADAGIGRLKVVFHLAVELGQGFEKAHREDGHAVVDFVVDAEFVAARFAGLPQAQQDSVDFAAQPCQRVGIGAAFALRQQCADAAVEAXDGLALHFGRVRGQNGGNGRIVQLPLHRFAVGFPRFEPADGFRQAAFRAAASGFFVDLAAAFVVHVFGDVQNLGEQAAGQGXIVGLLFVQLRQYFFNQCRAVVGSGQEFDCFDNQRRGFFVQEVEQGLFQKFRVRRQSRVLWIVQNMQLHDFSLSSAVNIVNVPQMPHPCQTVHTLTARVPKCRLKLNAARRQRYNRPQLFFSEHHHDHDRTRQRRCIPAAVQPPHPLGRNRHRRAAETFRRAYFGRRLRRFGCRRTXPTLPLRVSAR

SEQ ID NO: 1397 - DNA, 1723 bp, Neisseria meningitidis
atggtcgctgtatgtgatgaacggactgtacagtggacgttgatggctcaattcgcgcaacagggcggcttgtttttgctcttcgttgaggctgttgtagtcttccaagcctgcgtgttggaaaagctcggcaaccacatcggcgtgtttgcctgcgtgttggcgcaggtcgagcggcatcatgtggaagccgaacacggatacggaacggatgaggtctgccaaacggccttcggcaagcaggcggctgccgttgtcgataagggaatgttgcaattttttcaaatcatcgagaaattcttgtgccgaagcataaggctcgagaaagccgaatttgcagcccatacccaaaccgagcgcgcgcgctttgcccatagcgcgcgccataatgtaggcaatggcgcgacggtagggttcttcggcgcgggcggtttcttcgtcgggcgatttgtcggacaacgccatcacatcgccgttgactttgacgcggcggatggagagcggcagttcgcggtagagtttgtcgagttcgccacggtaaaaacggaacacggcatcggcgtggcggcggaaggcaaaacgcaaggtttcggcagaaacgaacggattgccgtcgcggtcgccgccgatccagccgccgattttgaggatgtccggaacgcggacatcgggataggccgtctgaaagtcgtgttccatcttgcggtagagcttgggcagggcttcaaaaaagctcatcggaaagatggacacgccgttgttgatttcgtcgttgacgctgagtttgtggcggcgcgtttcgctggtctgccacaagcccagcaggatagtgtcgatttcgcggcgcagccgtgccagcgcgtcggcattggtacagcgttcgcgttgcggcagcagcgcgcggatgcggcggttgaaattcaagacggtctggcgttgcacttcggtcgggtgcgcggtcaaaacggcggtaacggacgtattgtccaactgccgctgcaccgatttgccgtcggctttccccgctttgagcctgcggacggtttccgtcaggctgccttccgcgccgccgcgtccggcttcttcgtggatttggcggcggcgttcgtggtgcacgtcttcggcgatgttcaaaatctgggcgaacaggccgcaggccaaggttaaatcgtgggtttgttgttcgtccaattgcggcaatactttttcaatcaatgccgcgctgtcgtcggaagtggacaagagtttgaccgtttcgacaaccaacggcgaggcttcttcgtgcaggaggttgaacagggattgtttcagaaattccgcgtccgccgccaaagccgcgtcctttggattgttcagaatatgcagttgcatgatttttctctcattgccgtaaatactgtaaatgtacctcaaatgccgcatccgtgccaaaccgttcacactttaaccgcccgtgtcccgaaatgccgtctgaagttgaacgccgcccgacggcagcgttacaatcgcccacaactgttttttccgaacatcatcatgaccacgaccgaacacgacaacgacgatgcattcctgctgcggtacagccgccacatcctcttggacgaaattggcatcgaagggcagcagaaactttccgccgcgcatattttggtcgtcggctgcggcggtttgggtgccgccgccctgccctatctcgccgcttccggcatcggcacgctga

SEQ ID NO: 1398 - protein, 573 aa, Neisseria meningitidis
  misc_feature (507)..(507): Xaa can be any naturally occurring amino acid
  misc_feature (561)..(561): Xaa can be any naturally occurring amino acid
MVAVCDERTVQWTLMAQFAQQGGLFLLFVEAVVVFQACVLEKLGNHIGVFACVLAQVERHHVEAEHGYGTDEVCQTAFGKQAAAVVDKGMLQFFQIIEKFLCRSIRLEKAEFAAHTQTERARFAHSARHNVGNGATVGFFGAGGFFVGRFVGQRHHIAVDFDAADGERQFAVEFVEFATVKTEHGIGVAAEGKTQGFGRNERIAVAVAADPAADFEDVRNADIGIGRLKVVFHLAVELGQGFKKAHRKDGHAVVDFVVDAEFVAARFAGLPQAQQDSVDFAAQPCQRVGIGTAFALRQQRADAAVEIQDGLALHFGRVRGQNGGNGRIVQLPLHRFAVGFPRFEPADGFRQAAFRAAASGFFVDLAAAFVVHVFGDVQNLGEQAAGQGIVGLLFVQLRQYFFNQCRAVVGSGQEFDRFDNQRRGFFVQEVEQGLFQKFRVRRQSRVLWIVQNMQLHDFSLIAVNTVNVPQMPHPCQTVHTLTARVPKCRLKLNAARRQRYNRPQLFXSEHHHDHDRTRQRRCIPAAVQPPHPLGRNWHRRAAETFRRAYFGRRLRRFGCRXPCPISPLPASAR

SEQ ID NO: 1399 - DNA, 399 bp, Neisseria gonorrhoeae
atgccttcgcggacaccgcagggaaaaaggggttattcctgccccaagcgggatagtgccttttggcaggcgttgtccatatcggttattttacgcgcaaaatcgccgattgccaaatcgccgccgttcagggaggttttcaataggtcgtggacgacgttgagcgcggccataatgacgattttttcgctgtccgcgacgcggccgccttcgcggatggcttcggctttgccgttgagcattccgactgcctgcaacagtgtgtctttttcttctgccggcgtgttgacagtcagccggggcgtgcatgacttcgatgtagacttgttcgatgttcatcctttaatccttattgctgcgtttcctgccgttgggggaggcgcgctgccagtgcgctga

SEQ ID NO: 1400 - protein, 132 aa, Neisseria gonorrhoeae
MPSRTPQGKRGYSCPKRDSAFWQALSISVILRAKSPIAKSPPFREVFNRSWTTLSAAIMTIFSLSATRPPSRMASALPLSIPTACNSVSFSSAGVLTVSRGVHDFDVDLFDVHPLILIAAFPAVGGGALPVR

SEQ ID NO: 1401 - DNA, 399 bp, Neisseria meningitidis
  misc_feature (24)..(24): n is a, c, g, or t
atgccttcgcggacaccgcagggnaaaaggggttattcctgcgccaagcgggatagtgctttttggcaggcgttgtccatatcggctattttacgcgcaaaatcgccgattgccaaatcgccgccgttcagggaggttttcaacaggtcgtggacgacgttgagcgcggccataatgacgattttttcgctgtccgcgacgcgtccgccttcgcggatggcttcggctttgccgttgagcattccgactgcctgcaacagtgtgtctttttcttctgccggcgtgttgacggtcagccggggcgtgcawgacttcsatgtggacttgttcgatgttcatcctttaatccttattgctgcgtttcctgccattgggggaggcgcgctgccagtgcgctga

SEQ ID NO: 1402 - protein, 132 aa, Neisseria meningitidis
  misc_feature (103)..(103): Xaa can be any naturally occurring amino acid
  misc_feature (106)..(106): Xaa can be any naturally occurring amino acid
MPSRTPQGKRGYSCAKRDSAFWQALSISAILRAKSPIAKSPPFREVFNRSWTTLSAAIMTIFSLSATRPPSRMASALPLSIPTACNSVSFSSAGVLTVSRGVXDFXVDLFDVHPLILIAAFPAIGGGALPVR

SEQ ID NO: 1403 - DNA, 398 bp, Neisseria meningitidis
atgccttcgcggacaccgcagggaaaaaggggttattcctgcgccaagcgggatagtgctttttggcaggcgttgtccatatcggctattttacgcgcaaaatcgccgattgccaaatcgccgccgttcagggaggttttcaacaggtcgtggacgacgttgagcgcggccataatgacgattttttcgctgtccgcgacgcgtccgccttcgcggatggcttcggctttgccgttgagcattccgactgcctgcaacagtgtgtctttttcttctgccggcgtgttgacggtcagccgggcgtgcatgacttcgatgtggacttgttcgatgttcatcctttaatccttattgctgcgtttcctgccgttgggggaggcgcgctgccagtgcgctga

SEQ ID NO: 1404 - protein, 132 aa, Neisseria meningitidis
  misc_feature (101)..(101): Xaa can be any naturally occurring amino acid
MPSRTPQGKRGYSCAKRDSAFWQALSISAILRAKSPIAKSPPFREVFNRSWTTLSAAIMTIFSLSATRPPSRMASALPLSIPTACNSVSFSSAGVLTVSRXVHDFDVDLFDVHPLILIAAFPAVGGGALPVR

SEQ ID NO: 1405 - DNA, 834 bp, Neisseria meningitidis
atgaaagtgcttgttttaggtgcgggtgttgccggcgtatcctccgtgtggtatctggcagaggccggacatgaagtaacggtcatcgaccgcaccgagggtgtggcgatggaaaccagttttgccaatgcaggccagctttcttacggctataccacgccttgggctgcacccggtattccgaccaaagcactgaaacggctgtttaaaagccatccgcctttactgttccgccctgacggcggcctgtatcaaatcgaatggctgtggcggatgctgcaaaactgcacggcaacgcgctatcaaatcaataaagagcgcatggtcaggatttccgaatacagccgtgaaatgttccgccgttttgaagcgcaaaccgacatgaattttgagggacgcaaaaaagggacgttgcagattttccgccaaaccgaagaagtcgaagcggcaaaacaagacattgccgttttggaacgctacggcgtgccgtaccgccgtctgaagcccgaagaatgcgcagaattcgagcctgcgctggcacgcgttaccgccaaaattgtcggcggtctgcacctgcctgcggatgcgaccggcgactgccgcctcttcaccgaaaacctgtacaaattgtgtcaagagaagggggtacggttctacttcaaccaaaccatcagccgcatcgaccacaacgggctgcgcatcaaagccgttgaaacgaaacagggcggtttgaaacagatgccgttgtctgcgcgctcggctgcttcagcaggactgtgttggcgcagttggatctcaatctgcccatttatcccgtcaaaggctattccttga

SEQ ID NO: 1406 - protein, 277 aa, Neisseria meningitidis
MKVLVLGAGVAGVSSVWYLAEAGHEVTVIDRTEGVAMETSFANAGQLSYGYTTPWAAPGIPTKALKRLFKSHPPLLFRPDGGLYQIEWLWRMLQNCTATRYQINKERMVRISEYSREMFRRFEAQTDMNFEGRKKGTLQIFRQTEEVEAAKQDIAVLERYGVPYRRLKPEECAEFEPALARVTAKIVGGLHLPADATGDCRLFTENLYKLCQEKGVRFYFNQTISRIDHNGLRIKAVETKQGGLKQMPLSARSAASAGLCWRSWISICPFIPSKAIP

SEQ ID NO: 1407 - DNA, 369 bp, Neisseria meningitidis
gttttggaacgctacggcgtgccgtaccgccgtctgaaacccgaagaatgtgcagaatttgagcctgcgctggcacgcgttaccgccaaaattgccggcggcctgcacctgcctgcagatgcgaccggcgactggcgcctcttcactgaaaacctatacaaattgtgtcaggaaaagggcgtacggtttcatttcaaccaaaacatcagccgcatcgaccacaacgggctgcgcatcaaaaccgttgaaaccaaacagggcggtttgaagcagatgccgttgtctgcgcgctcggttgcttcagcaggacggttttggcgcagttggatctcaatctgcccatttatcccgtcaaaggctattccttga

SEQ ID NO: 1408 - protein, 122 aa, Neisseria meningitidis
VLERYGVPYRRLKPEECAEFEPALARVTAKIAGGLHLPADATGDWRLFTENLYKLCQEKGVRFHFNQNISRIDHNGLRIKTVETKQGGLKQMPLSARSVASAGRFWRSWISICPFIPSKAIP

SEQ ID NO: 1409 - DNA, 834 bp, Neisseria meningitidis
atgaaagtgcttgttttaggtgctggtgttgccggcgtatcttccgcgtggtatctggcagaggcaggacatgaagtaacggtcatcgaccgcgccgagggcgtggcgatggaaaccagttttgccaacgcaggccagctttcttacggctataccacgccttgggctgcacccggtattccgaccaaagcactgaaatggctgtttaaaagccatccgcctttgctgtttcgccccgacggcagcctgtatcaaatcgaatggctgtggcagatgctgcaacactgcacggcagcgcgctatcaaatcaataaagagcgcatggtcaggatgtccgaatacagccgtgaaatgttccgccgttttgaagcgcaaaccggcatgaattttgagggacgcaaaaaagggacgttgcagattttccgccaaaccaaagaagtcgaagcggcaaaacaagacattgccgttttggaacgctacggcgtgccgtaccgccgtctgaagcccgaagaatgcgcagaattcgagcctgcgctggcacgcgttaccgccaaaattgccggcggcctgcacctgcccgcagacgcgaccggcgactgccgcctcttcactgaaaacctgtacaaattgtgtcaggaaaagggcgtacggtttcatttcaaccaaaccatcagccgcatcgaccacaacgggctgcgcatcaaaaccgttgaaacgaaacagggcggtttgaagcagatgccgttgtctgcgcgctcggctgcttcagcaggacggttttggcgcaagtggatctcaatctgccgatttatcccgtcaaaggctattccttga

SEQ ID NO: 1410 - protein, 277 aa, Neisseria meningitidis
MKVLVLGAGVAGVSSAWYLAEAGHEVTVIDRAEGVAMETSFANAGQLSYGYTTPWAAPGIPTKALKWLFKSHPPLLFRPDGSLYQIEWLWQMLQHCTAARYQINKERMVRMSEYSREMFRRFEAQTGMNFEGRKKGTLQIFRQTKEVEAAKQDIAVLERYGVPYRRLKPEECAEFEPALARVTAKIAGGLHLPADATGDCRLFTENLYKLCQEKGVRFHFNQTISRIDHNGLRIKTVETKQGGLKQMPLSARSAASAGRFWRKWISICRFIPSKAIP

SEQ ID NO: 1411 - DNA, 576 bp, Neisseria gonorrhoeae
atgggttccgcgccgaacgccgccgccgccgccgaagtgaaacaccctgtttcgcaaggtatgattcaaatgctgggcgtgtttgtcgataccatcatcgtttgttcttgcaccgccttcatcatcttgatttaccaacagccttatggcgatttgagcggtgcggcgctgacgcaggcggcgattgtcagccaagtggggcaatggggcgcgggtttcctcgccgtcatcctgtttatgtttgccttttccaccgttatcggcaactatgcctatgccgagtccaacgtccaattcatcaaaagccattggctgattaccgccgttttccgtatgctggttttggcgtgggtctatttcggcgcggttgccaatgtgcctttggtctgggatatggcggatatggcgatgggcatcatggcgtggatcaacctcgtcgccatcctgctgctctcgccattggcgtttatgctgctgcgcgattacaccgccaagctgaaaatgggcaaagaccccgagttcaaactttccgaacatccgggcctgaaacgccgcatcaaatccgatgtttggtaa

SEQ ID NO: 1412 - protein, 191 aa, Neisseria gonorrhoeae
MGSAPNAAAAAEVKHPVSQGMIQMLGVFVDTIIVCSCTAFIILIYQQPYGDLSGAALTQAAIVSQVGQWGAGFLAVILFMFAFSTVIGNYAYAESNVQFIKSHWLITAVFRMLVLAWVYFGAVANVPLVWDMADMAMGIMAWINLVAILLLSPLAFMLLRDYTAKLKMGKDPEFKLSEHPGLKRRIKSDVW

SEQ ID NO: 1413 - DNA, 576 bp, Neisseria meningitidis; identical to SEQ ID NO: 1411

SEQ ID NO: 1414 - protein, 191 aa, Neisseria meningitidis; identical to SEQ ID NO: 1412

SEQ ID NO: 1415 - DNA, 1428 bp, Neisseria meningitidis
  misc_feature (79)..(79): n is a, c, g, or t
atgaacgagaactttaccgaatggctgcacggctgggtcggcgccatcaacgatccgatgtggtcatacttggtttatntgcttttgggtacggggcttttcttcaccgtaaccacgggctttgtccaattccgcctgttcgggcgcagcatcaaagaaatgctcggcggccgcaaacagggggacgaccctcacggcatcacgccgtttcaggcatttgtaaccggccttgccagccgcgtgggcgtgggcaatatcgcgggcgtggccatcgccatcaaagtcggcggaccgggcgcggtgttttggatgtgggtaaccgccttaatcggtatgagttcggcgtttgtcgaatcttcgctggcgcagctctttaaagtccgcgactacgacaaccaccatttccggggcggccctgcctactacatcactcaagggctggggcagaaatggctgggcgtgttgttcgccctgagcctgattttctgtttcggctttgtgtttgaagcggttcagaccaataccattgccgataccgtcaaagcggcgtggggttgggagcctcattatgtcggcgtcgccctggtgattttaaccgcgccgattatcttcggcggcatcaggcgcatatctaaagcggcggaaatcgtcgtccccctgatggcggttttgtacctctttatcgcgcttttcatcattttgaccaatattccgatgattccggacgtgttcggtcagattttttcgggcgcgttcaaattcgacgcggcagcaggcggcttactcggcggtctgatttcgcaaacgatgatgatgggcatcaaacgcggcctgtattccaacgaggcgggtatgggttccgcgccgaacgccgccgccgccgccgaagtgaaacaccctgtttcgcaaggtatgattcaaatgctgggcgtgtttgtcgataccatcatcgtttgttcttgcaccgccttcatcatcttgatttaccaacagccttacggcgatttgagcggtgcggcgctgacgcaggcggcgattgtcagccaagtggggcaatggggcgcgggcttcctcgccgtcatcctgtttatgtttgccttttccaccgttatcggcaactatgcctatgccgagtccaacgtccaattcatcaaaagccattggctgattaccgccgttttccgtatgctggttttggcgtgggtctatttcggcgcggttgccaatgtgcctttggtctgggatatggcggatatggcgatgggcattatggcgtggatcaaccttgtcgccatcctgctgctctcgcccttggcgtttatgctgctgcgcgattacaccgccaagctgaaaatgggcaaagaccccgagttcaaactttccgaacatccgggcctgaaacgccgtatcaaatccgacgtttggtaa

SEQ ID NO: 1416 - protein, 475 aa, Neisseria meningitidis
  misc_feature (27)..(27): Xaa can be any naturally occurring amino acid
MNENFTEWLHGWVGAINDPMWSYLVYXLLGTGLFFTVTTGFVQFRLFGRSIKEMLGGRKQGDDPHGITPFQAFVTGLASRVGVGNIAGVAIAIKVGGPGAVFWMWVTALIGMSSAFVESSLAQLFKVRDYDNHHFRGGPAYYITQGLGQKWLGVLFALSLIFCFGFVFEAVQTNTIADTVKAAWGWEPHYVGVALVILTAPIIFGGIRRISKAAEIVVPLMAVLYLFIALFIILTNIPMIPDVFGQIFSGAFKFDAAAGGLLGGLISQTMMMGIKRGLYSNEAGMGSAPNAAAAAEVKHPVSQGMIQMLGVFVDTIIVCSCTAFIILIYQQPYGDLSGAALTQAAIVSQVGQWGAGFLAVILFMFAFSTVIGNYAYAESNVQFIKSHWLITAVFRMLVLAWVYFGAVANVPLVWDMADMAMGIMAWINLVAILLLSPLAFMLLRDYTAKLKMGKDPEFKLSEHPGLKRRIKSDVW

SEQ ID NO: 1417 - DNA, 1080 bp, Neisseria gonorrhoeae
atggttcaaatacaggttgtgcgcgccgccggcgttgcccgtggtctgcattccgagtttgcgcgcgctgtaactgccgaggaaatagccttcgacaatgccgttttgaatcacgaagcgcggcgcggtggcaacaccttccgcatcaaaatagctgctgcggaaagagcgggggatgtgcggttcttcgcgcaggttgaggaaatcgggcaggacttttttgccgatgctgtcgatcaggaaactgctttggcggtagagcgcgccgccggagagtgtgccgacgaggtgtccgatcagcccgcccgaaacggtggtatcgaagaggacggggtagctgcctgtcgggatgctgcggctgccgagtcggcgcaaagtgcggcgggcggcggtttgaccgatggtttcggggctgtccatatccggatggcggcaggcggaatcgtaccagtagtcgcgctgcattccgttttcgtcggcggcgacgacgctgcaggaaatgctgtggtgcgtgctttgccggtgtgcggcaaaaccgtgggtgttgccgtaaacgtattggtactgtccggtttgcaccgccgcgccttcggagttttcgatgcggctgtccgtgtccaacgctgcctgttcgcattgttttgccaagccgacggcggcttccgtatccaaatcccattcgtggtaaaggtcggggtcgccgatgtgttgcgccatcaactcggggtcggcaagtccggcgcaaccgtcttcggcggtgtggcgggcgatgtcggcggcggcgcggacggtgtcgcgcagggcttgttcggagaagtcggcggtgccggcgcggcctttgcgtttgccgacgtaaacggtaatgtccagcgatttgtcctgctggaactcgatttgttcgatttcgcccaagcgcacgctgacgctttgtccgagcgattcgctgaagtcggcttcggcggcggtcgcgcccgctgcttttgccaagtcgagcgtgcggcggcagaggtcgaggagttcggaagcggtgtggttgaacagcataacaatctttcttggtggagcgttgtggcattttaa

SEQ ID NO: 1418 - protein, 359 aa, Neisseria gonorrhoeae
MVQIQVVRAAGVARGLHSEFARAVTAEEIAFDNAVLNHEARRGGNTFRIKIAAAERAGDVRFFAQVEEIGQDFFADAVDQETALAVERAAGECADEVSDQPARNGGIEEDGVAACRDAAAAESAQSAAGGGLTDGFGAVHIRMAAGGIVPVVALHSVFVGGDDAAGNAVVRALPVCGKTVGVAVNVLVLSGLHRRAFGVFDAAVRVQRCLFALFCQADGGFRIQIPFVVKVGVADVLRHQLGVGKSGATVFGGVAGDVGGGADGVAQGLFGEVGGAGAAFAFADVNGNVQRFVLLELDLFDFAQAHADALSERFAEVGFGGGRARCFCQVERAAAEVEEFGSGVVEQHNNLSWWSVVAF

SEQ ID NO: 1419 - DNA, 918 bp, Neisseria meningitidis
ggaaagagcgggggatgtgcgttcttcgcgcaggttgaggaaatcgggcaggacttttctgccgatgctgtcgatcaggaaactgctttggcggtagagcgcgccgccggagagtgcgccgacgaggtgtccgataagaccgcccgaaacggtggtatcgaagaggacggggtagctgcctgtcgggatgctgcggctgccgagtcggcgcaaagtgcggcgggcggcggtttgaccgatggtttcggggctgtccatatccggatggcggcaggcggaatcgtaccagtagtcgcgctgcatgccgttttcgtcggcggcaacgacgctgcaggaaatgctgtggtgcgtgccttgccggtgtgcggcaaaaccgtgggtgttgccgtaaacgtattggtaatggccggtttgcaccgccgcgccttcggagttttcgatgcgctcatcctcgttcagggcggcttgttcgcattgttttgccaagccgacggcggctkccgtatccaaatcccattcgtggtaaaggtcggggtcgccgatgtgttttgccatcagacaggcatcggcaagtccggcgcaaccgtcttcggcggtgtggcgggcgatgtcgatggcggctttgacggtgtcttgcagggctttttcggagaagtcggcagtactggcgcggcctttgcgtttgccgacgtaaacggtaatgtccagcgacttgtcctgctggaactcgatttgttsgatttsgcccagccgcacgctgacgctttgtcccaatgattcgctgaaatcggcttcggcggcggttgcgcccgtcgcttttgccaagtcgagcgtgcggcggcagaggtcgaggagttcggaagcggtgtggttgaacagcatagaaatctttcttgatgatgctttgcggcattttaa

SEQ ID NO: 1420 - protein, 305 aa, Neisseria meningitidis
  misc_feature (167)..(167): Xaa can be any naturally occurring amino acid
  misc_feature (246)..(246): Xaa can be any naturally occurring amino acid
  misc_feature (248)..(248): Xaa can be any naturally occurring amino acid
  misc_feature (259)..(259): Xaa can be any naturally occurring amino acid
  misc_feature (299)..(300): Xaa can be any naturally occurring amino acid
GKSGGCAFFAQVEEIGQDFSADAVDQETALAVERAAGECADEVSDKTARNGGIEEDGVAACRDAAAAESAQSAAGGGLTDGFGAVHIRMAAGGIVPVVALHAVFVGGNDAAGNAVVRALPVCGKTVGVAVNVLVMAGLHRRAFGVFDALILVQGGLFALFCQADGGXRIQIPFVVKVGVADVFCHQTGIGKSGATVFGGVAGDVDGGFDGVLQGFFGEVGSTGAAFAFADVNGNVQRLVLLELDLXDXAQPHADALSQXFAEIGFGGGCARRFCQVERAAAEVEEFGSGVVEQHRNLSXXCFAAF

SEQ ID NO: 1421 - DNA, 1080 bp, Neisseria meningitidis
  misc_feature (775)..(778): n is a, c, g, or t
atggttcaaataaaggttgtgcgcgccgccggcgttgcccgtggtctgcattccgagtttgcgcgcgctgtaactgctgaggaaatagccttcgacaatgccgttttgaatcacgaagcgcggtgcggtggcaacgccttccgcatcaaaatagctgctgcggaaagagcgggggatgtgcggttcttcgcgcaggttgaggaaatcgggcaggacttttttgccgatgctgtcgatcaggaaactgctttggcggtagagcgctccgccggagagtgcgccgacgaggtgtccgataagaccgcccgaaacggtggtatcgaagaggacggggtagttgcctgtcgggatgctgcggctgccgagtcggcgcaaagtgcggcgggcggcggtttgaccgatggtttcggggctgtccatatccggatggcggcaggcggaatcgtaccagtagtcgcgctgcatgccgttttcgtcggcggcaacgacgctgcaggaaatgctgtggtgcgtgctttgccggtgtgcggcaaaaccgtaggtgttgccgtaaacgtattggtaatggccggtttgcaccgccgcgccttcggagttttcgatgcgctcatcctcgttcagggcggcttgttcgcattgttttgccaagccgacggcggcttccgtatccaaatcccattcgtggtaaaggtcggggtcgccgatgtgttgcgccatcaactcggggtcggcaagtccggcgcaaccgtcttcggcggtgtggcgggcgatgtcnnnngcggcgcggacggtgtcgcgcagggcttgttcggagaaatcggcggtgccggcgcggcctttgcgtttgccgacgtaaacggtaatgtccagcgacttgtcctgctgaaactcgatttgttcgatttcgcccagccgcacgctgacgctttgtcccaatgattcgctgaaatcggcttcggcggcggttgcgcccgtcgcttttgccaagtcgagcgtgcggcggcagaggtcgaggagttcggaagcggtgtggttgaacagcatagaaatctttcttgatgatgctttgcggcattttaa

SEQ ID NO: 1422 - protein, 356 aa, Neisseria meningitidis
  misc_feature (259)..(260): Xaa can be any naturally occurring amino acid
MVQIKVVRAAGVARGLHSEFARAVTAEEIAFDNAVLNHEARCGGNAFRIKIAAAERAGDVRFFAQVEEIGQDFFADAVDQETALAVERSAGECADEVSDKTARNGGIEEDGVVACRDAAAAESAQSAAGGGLTDGFGAVHIRMAAGGIVPVVALHAVFVGGNDAAGNAVVRALPVCGKTVGVAVNVLVMAGLHRRAFGVFDALILVQGGLFALFCQADGGFRIQIPFVVKVGVADVLRHQLGVGKSGATVFGGVAGDVXXGADGVAQGLFGEIGGAGAAFAFADVNGNVQRLVLLKLDLFDFAQPHADALSQFAEIGFGGGCARRFCQVERAAAEVEEFGSGVVEQHRNLSCFAAF

SEQ ID NO: 1423 - DNA, 1080 bp, Neisseria gonorrhoeae
atggttcaaatacaggttgtgcgcgccgccggcgttgcccgtggtctgcattccgagtttgcgcgcgctgtaactgccgaggaaatagccttcgacaatgccgttttgaatcacgaagcgcggcgcggtggcaacaccttccgcatcaaaatagctgctgcggaaagagcgggggatgtgcggttcttcgcgcaggttgaggaaatcgggcaggacttttttgccgatgctgtcgatcaggaaactgctttggcggtagagcgcgccgccggagagtgtgccgacgaggtgtccgatcagcccgcccgaaacggtggtatcgaagaggacggggtagctgcctgtcgggatgctgcggctgccgagtcggcgcaaagtgcggcgggcggcggtttgaccgatggtttcggggctgtccatatccggatggcggcaggcggaatcgtaccagtagtcgcgctgcattccgttttcgtcggcggcaacgacgctgcaggaaatgctgtggtgcgtgctttgccggtgtgcggcaaaaccgtgggtgttgccgtaaacgtattggtagtgtccggtttgcaccgccgcgccttcggagttttcgatgcggctgtccgtgtccaacgctgcctgttcgcattgttttgccaagccgacggcggcttccgtatccaaatcccattcgtggtaaaggtcggggtcgccgatgtgttgcgccatcaactcggggtcggcaagtccggcgcaaccgtcttcggcggtgtggcgggcgatgtcggcggcggcgcggacggtgtcgcgcagggcttgttcggagaagtcggcggtgccggcgcggcctttgcgtttgccgacgtaaacggtaatgtccagcgatttgtcctgctggaactcgatttgttcgatttcgcccaagcgcacgctgacgctttgtccgagcgattcgctgaagtcggcttcggcggcggtcgcgcccgctgcttttgccaagtcgagcgtgcggcggcagaggtcgaggagttcggaagcggtgtggttgaacagcataacaatctttcttggtggagcgttgtggcattttaa

SEQ ID NO: 1424 - protein, 359 aa, Neisseria gonorrhoeae
MVQIQVVRAAGVARGLHSEFARAVTAEEIAFDNAVLNHEARRGGNTFRIKIAAAERAGDVRFFAQVEEIGQDFFADAVDQETALAVERAAGECADEVSDQPARNGGIEEDGVAACRDAAAAESAQSAAGGGLTDGFGAVHIRMAAGGIVPVVALHSVFVGGNDAAGNAVVRALPVCGKTVGVAVNVLVVSGLHRRAFGVFDAAVRVQRCLFALFCQADGGFRIQIPFVVKVGVADVLRHQLGVGKSGATVFGGVAGDVGGGADGVAQGLFGEVGGAGAAFAFADVNGNVQRFVLLELDLFDFAQAHADALSERFAEVGFGGGRARCFCQVERAAAEVEEFGSGVVEQHNNLSWWSVVAF

SEQ ID NO: 1425 - DNA, 939 bp, Neisseria meningitidis
atggttcaaatacaggttgtgcgcgccgccggcgttgcccgtggtctgcataccgagtttgcgcgcgctgtaactgctgaggaaatagccttcgacaatgccgttttgaatcacgaagcgcggtgcggtggcaacgccttccgcatcaaaatagctgctgcggaaagagcgggggatgtgcggttcttcgcgcaggttgaggaaatcgggcaggacttttttgccgatgctgtcgatcaggaaactgctttggcggtagagcgcgccgccggagagtgcgccgacgaggtgtccgataagaccgcccgaaacggtggtatcgaagaggacggggtagctgcctgtcgggatgctgcggctgccgagtcggcgcaaagtgcggcgggcggcggtttgaccgatggtttcggggctgtccatatccggatggcggcaggcggaatcgtaccagtagtcgcgctgcatgccgttttcgtcggcggcaacgacgctgcaggaaatgctgtggtgcgtgccttgccggtgtgcggcaaaaccgtgggtgttgccgtaaacgtattggtaatggccggtttgcaccgccgcgccttcggagttttcgatgcgctcatcctcgttcagggcggcttgttcgcattgttttgccaagccgacggcggcttccgtatccaaatcccattcgtggtaaaggtcggggtcgccgatgtgttttgccatcagacaggcatcggcaagtccggcgcaaccgtcttcggcggtgtggcgggcgatgtcgatggcggctttgacggtgtcttgcagggctttttcggagaagtcggcagtactggcgcggcctttgcgtttgccgacgtaaacggtaatgtccagcgacttgtcctgctggaactcgatttgttcgatttcgcccagccgcacgctgacgctttgtcccaatga

SEQ ID NO: 1426 - protein, 312 aa, Neisseria meningitidis
MVQIQVVRAAGVARGLHTEFARAVTAEEIAFDNAVLNHEARCGGNAFRIKIAAAERAGDVRFFAQVEEIGQDFFADAVDQETALAVERAAGECADEVSDKTARNGGIEEDGVAACRDAAAAESAQSAAGGGLTDGFGAVHIRMAAGGIVPVVALHAVFVGGNDAAGNAVVRALPVCGKTVGVAVNVLVMAGLHRRAFGVFDALILVQGGLFALFCQADGGFRIQIPFVVKVGVADVFCHQTGIGKSGATVFGGVAGDVDGGFDGVLQGFFGEVGSTGAAFAFADVNGNVQRLVLLELDLFDFAQPHADALSQ

SEQ ID NO: 1427 - DNA, 939 bp, Neisseria meningitidis
atggttcaaataaaggttgtgcgcgccgccggcgttgcccgtggtctgcattccgagtttgcgcgcgctgtaactgctgaggaaatagccttcgacaatgccgttttgaatcacgaagcgcggtgcggtggcaacgccttccgcatcaaaatagctgctgcggaaagagcgggggatgtgcggttcttcgcgcaggttgaggaaatcgggcaggacttttttgccgatgctgtcgatcaggaaactgctttggcggtagagcgctccgccggagagtgcgccgacgaggtgtccgataagaccgcccgaaacggtggtatcgaagaggacggggtagttgcctgtcgggatgctgcggctgccgagtcggcgcaaagtgcggcgggcggcggtttgaccgatggtttcggggctgtccatatccggatggcggcaggcggaatcgtaccagtagtcgcgctgcatgccgttttcgtcggcggcaacgacgctgcaggaaatgctgtggtgcgtgctttgccggtgtgcggcaaaaccgtaggtgttgccgtaaacgtattggtaatggccggtttgcaccgccgcgccttcggagttttcgatgcgctcatcctcgttcagggcggcttgttcgcattgttttgccaagccgacggcggcttccgtatccaaatcccattcgtggtaaaggtcggggtcgccgatgtgttgcgccatcaactcggggtcggcaagtccggcgcaaccgtcttcggcggtgtggcgggcgatgtcggcggcggcgcggacggtgtcgcgcagggcttgttcggagaaatcggcggtgccggcgcggcctttgcgtttgccgacgtaaacggtaatgtccagcgacttgtcctgctgaaactcgatttgttcgatttcgcccagccgcacgctgacgctttgtcccaatga

SEQ ID NO: 1428 - protein, 312 aa, Neisseria meningitidis
MVQIKVVRAAGVARGLHSEFARAVTAEEIAFDNAVLNHEARCGGNAFRIKIAAAERAGDVRFFAQVEEIGQDFFADAVDQETALAVERSAGECADEVSDKTARNGGIEEDGVVACRDAAAAESAQSAAGGGLTDGFGAVHIRMAAGGIVPVVALHAVFVGGNDAAGNAVVRALPVCGKTVGVAVNVLVMAGLHRRAFGVFDALILVQGGLFALFCQADGGFRIQIPFVVKVGVADVLRHQLGVGKSGATVFGGVAGDVGGGADGVAQGLFGEIGGAGAAFAFADVNGNVQRLVLLKLDLFDFAQPHADALSQ

SEQ ID NO: 1429 - DNA, 714 bp, Neisseria gonorrhoeae
atgttgttccgtaaaacgaccgccgccgttttggcggcaaccttgatactgaacggctgtacgatgatgttgcgggggatgaacaacccggtcagccaaacaatcacccgcaaacacgttgacaaagaccaaatccgcgccttcggtgtggttgccgaagacaatgcccaattggaaaagggcagcctggtgatgatgggcgggaaatactggttcgccgtcaatcccgaagattcggcgaagctgacgggccttttgaaggccgggttggacaagcccttccaaatagttgaggataccccgagctatgcccgccaccaagccctgccggtcaaattcgaagcgcccggcagccagaatttcagtaccggaggtctttgcctgcgctatgataccggcagacctgacgacatcgccaagctgaaacagcttgagtttaaagcggtcaaactcgacaatcggaccatttacacgcgctgcgtatccgccaaaggcaaatactacgccacgccgcaaaaactgaacgccgattatcattttgagcaaagtgtgcccgccgatatttattatacggttactgaaaaacataccgacaaatccaagctgtttggaaatatcttatatacgccccccttgttgatattggatgcggcggccgcggtgctggtcttgcctatggctctgattgcagccgcgaattcctcagacaaatga

SEQ ID NO: 1430 - protein, 237 aa, Neisseria gonorrhoeae
MLFRKTTAAVLAATLILNGCTMMLRGMNNPVSQTITRKHVDKDQIRAFGVVAEDNAQLEKGSLVMMGGKYWFAVNPEDSAKLTGLLKAGLDKPFQIVEDTPSYARHQALPVKFEAPGSQNFSTGGLCLRYDTGRPDDIAKLKQLEFKAVKLDNRTIYTRCVSAKGKYYATPQKLNADYHFEQSVPADIYYTVTEKHTDKSKLFGNILYTPPLLILDAAAAVLVLPMALIAAANSSDK

SEQ ID NO: 1431 - DNA, 717 bp, Neisseria meningitidis
atgttgttccgtaaaacgaccgccgccgttttggcggcaaccttgatgctgaacggctgtacgttgatgttgtggggaatgaacaacccggtcagcgaaacaatcacccgcaaacacgttgacaaagaccaaatccgcgccttcggtgtggttgccgaagacaatgcccaattggaaaagggcagcctggtgatgatgggcggaaaatactggttcgtcgtcaatcccgaagattcggcgaagctgacgggcattttgaaggcagggctggacaaacccttccaaatagttgaggataccccgagctatgctcgccaccaagccctgccggtcaaactcgaatcgcctggcagccagaatttcagtaccgaaggcctttgcctgcgctacgataccgacaagcctgccgacatcgccaagctgaaacagctcgggtttgaagcggtcaaactcgacaatcggaccatttacacgcgctgcgtatccgccaaaggcaaatactacgccacaccgcaaaaactgaacgccgattaccattttgagcaaagtgtgcctgccgatatttattacacggttactgaagaacataccgacaaatccaagctgtttgcaaatatcttatatacgcccccctttttgatactggatgcggcgggcgcggtactggccttgcctgcggcggctctgggtgcggtcgtggatgccgcccgcaaatga

SEQ ID NO: 1432 - protein, 238 aa, Neisseria meningitidis
MLFRKTTAAVLAATLMLNGCTLMLWGMNNPVSETITRKHVDKDQIRAFGVVAEDNAQLEKGSLVMMGGKYWFVVNPEDSAKLTGILKAGLDKPFQIVEDTPSYARHQALPVKLESPGSQNFSTEGLCLRYDTDKPADIAKLKQLGFEAVKLDNRTIYTRCVSAKGKYYATPQKLNADYHFEQSVPADIYYTVTEEHTDKSKLFANILYTPPFLILDAAGAVLALPAAALGAVVDAARK

SEQ ID NO: 1433 - DNA, 714 bp, Neisseria meningitidis
atgttgttccgtaaaacgaccgccgccgttttggcggcaaccttgatgttgaacggctgtacggtaatgatgtggggtatgaacagcccgttcagcgaaacgaccgcccgcaaacacgttgacaaggaccaaatccgcgccttcggtgtggttgccgaagacaatgcccaattggaaaagggcagcctggtgatgatgggcgggaaatactggttcgtcgtcaatcctgaagattcggcgaagctgacgggcattttgaaggccgggttggacaagcagtttcaaatggttgagcccaacccgcgctttgcctaccaagccctgccggtcaaactcgaatcgcccgccagccagaatttcagtaccgaaggcctttgcctgcgctacgataccgacagacctgccgacatcgccaagctgaaacagcttgagtttgaagcggtcgaactcgacaatcggaccatttacacgcgctgcgtctccgccaaaggcaaatactacgccacaccgcaaaaactgaacgccgattatcattttgagcaaagtgtgcctgccgatatttattacacggttacgaaaaaacataccgacaaatccaagttgtttgaaaatattgcatatacgcccaccacgttgatactggatgcggtgggcgcggtgctggccttgcctgtcgcggcgttgattgcagccacgaattcctcagacaaatga

SEQ ID NO: 1434 - protein, 237 aa, Neisseria meningitidis
MLFRKTTAAVLAATLMLNGCTVMMWGMNSPFSETTARKHVDKDQIRAFGVVAEDNAQLEKGSLVMMGGKYWFVVNPEDSAKLTGILKAGLDKQFQMVEPNPRFAYQALPVKLESPASQNFSTEGLCLRYDTDRPADIAKLKQLEFEAVELDNRTIYTRCVSAKGKYYATPQKLNADYHFEQSVPADIYYTVTKKHTDKSKLFENIAYTPTTLILDAVGAVLALPVAALIAATNSSDK

SEQ ID NO: 1435 - DNA, 504 bp, Neisseria gonorrhoeae
atgcatcgggtttcagacggcattggagtgtcagtcgtgttctgccgattcgtaggcttcgacgattttttgcaccagaggatgccggacaacgtcttcgccggtgaaggtatggaaatacagtcctgccacgccgtgcagtttctcacgtgcgtctttcaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatataggcgagcggggcgatttcaatcaggcctttttcaatcagcttggttacacggtcaaagcccatcaggtcatagagggcatcataaagcggacggaggtaggggtcgactttttgggtcaggtctccgggcaggaagcccagtttctcaccggcttcgacggcaggccgaactaa

SEQ ID NO: 1436 - protein, 167 aa, Neisseria gonorrhoeae
MHRVSDGIGVSVVFCRFVGFDDFLHQRMPDNVFAGEGMEIQSCHAVQFLTCVFQSRFDVFGQVDLAGVAGNDGFRAEADAGQEHFHLFGRGVLRFVEDDVCAVERPAAHIGERGDFNQAFFNQLGYTVKAHQVIEGIIKRTEVGVDFLGQVSGQEAQFLTGFDGRPN

SEQ ID NO: 1437 - DNA, 504 bp, Neisseria meningitidis
atgcatcgggtttcagacggcattggaatgtcagtcgtgttctgccgattcgtaggcttcgacgattttttgcaccaaaggatgccggacaacgtcttcgccggtaaaggtgtggaaatacagcccttccacgttgtgcagtttctcacgcgcatcttttaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatataggcgagcggggcgatttcaatcaggcctttttcaatcagcttggttacacggtcaaagcccatcaggtcatagagggcatcataaagcggacgaaggtagggatcgactttctgggtcaggtctccgggcaggaagcccagtttctcgccggcttcgacggctgggcgcactaa

SEQ ID NO: 1438 - protein, 167 aa, Neisseria meningitidis
  misc_feature (54)..(54): Xaa can be any naturally occurring amino acid
MHRVSDGIGMSVVFCRFVGFDDFLHQRMPDNVFAGKGVEIQPFHVVQFLTRIFXSRFDVFGQVDLAGVAGNDGFRAEADAGQEHFHLFGRGVLRFVEDDVCAVERPAAHIGERGDFNQAFFNQLGYTVKAHQVIEGIIKRTKVGIDFLGQVSGQEAQFLAGFDGWAH

SEQ ID NO: 1439 - DNA, 504 bp, Neisseria meningitidis
atgcatcgggtttcagacggcattggaatgtcagtcgtgttctgccgattcgtaggcttcgacgattttttgcaccaaaggatgccggacaacgtcttcgccggtaaaggtgtggaaatacagcccttccacgccgtgcagtttctcacgcgcatcttttaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatataggcgagcggggcaatctcaatcagacctttttcaatcagcttggtgacacggtcgaagcccatcaggtcatagagggcatcataaagcggacgaaggtagggatcgactttctgggtcaggtcaccgggcagaaaacccagtttctcgccggcttcgacggcaggccgcactaa

SEQ ID NO: 1440 - protein, 166 aa, Neisseria meningitidis
MHRVSDGIGMSVVFCRFVGFDDFLHQRMPDNVFAGKGVEIQPFHAVQFLTRIFSRFDVFGQVDLAGVAGNDGFRAEADAGQEHFHLFGRGVLRFVEDDVCAVERPAAHIGERGNLNQTFFNQLGDTVEAHQVIEGIIKRTKVGIDFLGQVTGQKTQFLAGFDGRPH

SEQ ID NO: 1441 - DNA, 348 bp, Neisseria gonorrhoeae
atgacgttttcggcggcaaagctcaacatttcggcactgatgttgtgtctttcggcaggaatgaccgttttactttccgcttttttactgctccgaccggaaggcagcatcttattcaaccattttttcagcataaatattctgacccgaagagcggcatctccacgggcaaccgtgttcagactgcatcaggcggtacgattccacaagatgccgaaaaccataagcaaaatgcgtagaaactacgccgtccgaatcacgccgcctcctcgggcggcaacgcttcattataacagattgccccttaaaaaatcagaccctgcttttgtggcggagtctgaaatttga

SEQ ID NO: 1442 - protein, 115 aa, Neisseria gonorrhoeae
MTFSAAKLNISALMLCLSAGMTVLLSAFLLLRPEGSILFNHFFSINILTRRAASPRATVFRLHQAVRFHKMPKTISKMRRNYAVRITPPPRAATLHYNRLPLKKSDPAFVAESEI

SEQ ID NO: 1443 - DNA, 401 bp, Neisseria meningitidis
atgacgttttcggcggcaaagctcaacatttcggcacggatgttgtgtctttcggcaggaatgaccgttttactttccgcttttttactgctccgaccggaaggcagcatcttattcaaccattttttcagcataaatattctgacccgaagagcggcatctccacaggcaaccgtgttcagacggcatcaggcgcggtttgcaagatgccgtaccataaacaaaaggcgtagaaactacgccgtccgaatcacgccgccctcgcggcggcaacgcgtcattataacagattgccctccgcggcaggcttagtgcggcgggagcgccgccgttgcgcagtaatattgtctaacgggaggaaaaaatcagaccctgcttttgtggcagagtctgaaatttga

SEQ ID NO: 1444 - protein, 133 aa, Neisseria meningitidis
  misc_feature (89)..(89): Xaa can be any naturally occurring amino acid
MTFSAAKLNISARMLCLSAGMTVLLSAFLLLRPEGSILFNHFFSINILTRRAASPQATVFRRHQARFARCRTINKRRRNYAVRITPPSXAATRHYNRLPSAAGLVRRERRRCAVILSNGRKKSDPAFVAESEI

SEQ ID NO: 1445 - DNA, 344 bp, Neisseria meningitidis
atgacgttttcggcggcaaagctcaacatttcggcacggatgttgtgtctttcggcaggaatgaccgttttactttccgcttttttactgctccgaccggaaggcagcatcttattcaaccattttttcagcataaatattctaacccgaagagcggcatctccacgggcaaccgtgttcagacggcatcaggcggtacgattccgcaagatgccgaccataaacaaaaggcgtagaaactacgccgtccgaatcacgccgtcctcgcggcggcaacgcgtcattataacagattgccctccaaaaaatcagaccctgcttttgtggcagagtctgaaatttga

SEQ ID NO: 1446 - protein, 114 aa, Neisseria meningitidis
  misc_feature (90)..(90): Xaa can be any naturally occurring amino acid
MTFSAAKLNISARMLCLSAGMTVLLSAFLLLRPEGSILFNHFFSINILTRRAASPRATVFRRHQAVRFRKMPTINKRRRNYAVRITPSSXAATRHYNRLPSKKSDPAFVAESEI

SEQ ID NO: 1447 - DNA, 951 bp, Neisseria gonorrhoeae
atggaatttttcattatcttgttggcagccgtcgccgttttcggcttcaaatcctttgtcgtcatcccccagcaggaagtccacgttgtcgaaaggctcgggcgtttccatcgcgccctgacggccggtttgaatattttgattccctttatcgaccgcgtcgcctaccgccattcgctgaaagaaatccctttagacgtacccagccaggtctgcatcacgcgcgataatacgcaattgactgttgacggcatcatctatttccaagtaaccgatcccaaactcgcctcatacggttcgagcaactacattatggcaattacccagcttgcccaaacgacgctgcgttccgttatcgggcgtatggagttggacaaaacgtttgaagaacgcgacgaaatcaacagtaccgtcgtctccgccctcgatgaagccgccggggcttggggtgtgaaagtcctccgttacgaaatcaaggatttggttccgccgcaagaaatccttcgcgcaatgcaggcacaaattaccgccgaacgcgaaaaacgcgcccgtattgccgaatccgaaggccgtaaaatcgaacaaatcaaccttgccagtggtcagcgtgaagccgaaatccaacaatccgaaggcgaggctcaggctgcggtcaatgcgtccaatgccgagaaaatcgcccgcatcaaccgcgccaaaggcgaagcggaatccctgcgccttgttgccgaagccaatgccgaagccaaccgtcaaattgccgccgcccttcaaacccaaagcggggcggatgcggtcaatctgaagattgcgggacaatacgttaccgcgttcaaaaatcttgccaaagaagacaatacgcggattaagcccgccaaggttgccgaaatcgggaaccctaattttcggcggcatgaaaaattttcgccagaagcaaaaacggccaaataa

SEQ ID NO: 1448 - protein, 316 aa, Neisseria gonorrhoeae
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRAMQAQITAEREKRARIAESEGRKIEQINLASGQREAEIQQSEGEAQAAVNASNAEKIARINRAKGEAESLRLVAEANAEANRQIAAALQTQSGADAVNLKIAGQYVTAFKNLAKEDNTRIKPAKVAEIGNPNFRRHEKFSPEAKTAK

SEQ ID NO: 1449 - DNA, 600 bp, Neisseria meningitidis
tccgttatcgggcgtatggagttggacaaaacgtttgaagaacgcgacgaaatcaacagtactgttgttgcggctttggacgaggcggccggggcttggggtgtgaaggttttgcgttatgagattaaagacttggttccgccgcaagaaatccttcgctcaatgcaggcgcaaattactgccgaacgcgaaaaacgcgcccgtatcgccgaatccgaaggtcgtaaaatcgaacaaatcaaccttgccagtggtcagcgcgaagccgaaatccaacaatccgaaggcgaggctcaggctgcggtcaatgcgtcaaatgccgagaaaatcgcccgcatcaaccgcgccaaaggtgaagcggaatccttgcgccttgttgccgaagccaatgccgaagccatccgtcaaattgccgccgcccttcaaacccaaggcggtgcggatgcggtcaatctgaagattgcggaacaatacgtcgctgcgttcaacaatcttgccaaagaaagcaatacgctgattatgcccgccaatgttgccgacatcggcagcctgatttctgccggtatgaaaattatcgacagcagcaaaaccgccaaataa

SEQ ID NO: 1450 - protein, 199 aa, Neisseria meningitidis
SVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 1451 - DNA, 948 bp, Neisseria meningitidis
atggaatttttcattatcttgctggcagccgtcgttgttttcggcttcaaatcctttgttgtcatcccacagcaggaagtccacgttgtcgaaaggctcgggcgtttccatcgcgccctgacggccggtttgaatattttgattccctttatcgaccgcgtcgcctaccgccattcgctgaaagaaatccctttagacgtacccagccaggtctgcatcacgcgcgacaatacgcagctgactgttgacggtatcatctatttccaagtaaccgaccccaaactcgcctcatacggttcgagcaactacattatggcgattacccagcttgcccaaacgacgctgcgttccgttatcgggcgtatggaattggacaaaacgtttgaagaacgcgacgaaatcaacagcaccgtcgtctccgccctcgatgaagccgccggagcttggggtgtgaaggttttgcgttatgagattaaagacttggttccgccgcaagaaatccttcgctcaatgcaggcgcaaattactgctgaacgcgaaaaacgcgcccgtatcgccgaatccgaaggtcgtaaaatcgaacaaatcaaccttgccagtggtcagcgcgaagccgaaatccaacaatccgaaggcgaggctcaggctgcggtcaatgcgtcaaatgccgagaaaatcgcccgcatcaaccgcgccaaaggtgaagcggaatccttgcgccttgttgccgaagccaatgccgaagccatccgtcaaattgccgccgcccttcaaacccaaggcggtgcggatgcggtcaatctgaagattgcggaacaatacgtcgccgcgttcaacaatcttgccaaagaaagcaatacgctgattatgcccgccaatgttgccgacatcggcagcctgatttctgccggtatgaaaattatcgacagcagcaaaaccgccaaataa

SEQ ID NO: 1452 - protein, 315 aa, Neisseria meningitidis
MEFFIILLAAVVVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 1453 - DNA, 948 bp, Neisseria gonorrhoeae
atggaatttttcattatcttgttggcagccgtcgccgttttcggcttcaaatcctttgtcgtcatcccccagcaggaagtccacgttgtcgaaaggctcgggcgtttccatcgcgccctgacggccggtttgaatattttgattccctttatcgaccgcgtcgcctaccgccattcgctgaaagaaatccctttagacgtacccagccaggtctgcatcacgcgcgataatacgcaattgactgttgacggcatcatctatttccaagtaaccgatcccaaactcgcctcatacggttcgagcaactacattatggcaattacccagcttgcccaaacgacgctgcgttccgttatcgggcgtatggagttggacaaaacgtttgaagaacgcgacgaaatcaacagtaccgtcgtctccgccctcgatgaagccgccggggcttggggtgtgaaagtcctccgttacgaaatcaaggatttggttccgccgcaagaaatccttcgcgcaatgcaggcacaaattaccgccgaacgcgaaaaacgcgcccgtattgccgaatccgaaggccgtaaaatcgaacaaatcaaccttgccagtggtcagcgtgaagccgaaatccaacaatccgaaggcgaggctcaggctgcggtcaatgcgtccaatgccgagaaaatcgcccgcatcaaccgcgccaaaggcgaagcggaatccctgcgccttgttgccgaagccaatgccgaagccatccgtcaaattgccgccgcccttcaaacccaaggcggggcggatgcggtcaatctgaagattgcggaacaatacgtagccgcgttcaacaatcttgccaaagaaagcaatacgctgattatgcccgccaatgttgccgacatcggcagcctgatttctgccggcatgaaaattatcgacagcagcaaaaccgccaaataa

SEQ ID NO: 1454 - protein, 315 aa, Neisseria gonorrhoeae
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRAMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 1455 - DNA, 948 bp, Neisseria meningitidis
atggaatttttcattatcttgttggtagccgtcgccgttttcggtttcaaatcctttgttgtcatcccacaacaggaagtccacgttgtcgaaaggctggggcgtttccatcgcgccctgacggccggtttgaatattttgattccctttatcgaccgcgtcgcctaccgccattcgctgaaagaaatccctttagacgtacccagccaggtctgcatcacgcgcgacaatacgcagctgactgttgacggcatcatctatttccaagtaaccgaccccaaactcgcctcatacggttcgagcaactacattatggcgattacccagcttgcccaaacgacgctgcgttccgttatcgggcgtatggagttggacaaaacgtttgaagaacgcgacgaaatcaacagtactgttgttgcggctttggacgaggcggccggggcttggggtgtgaaggttttgcgttatgagattaaagacttggttccgccgcaagaaatccttcgctcaatgcaggcgcaaattactgccgaacgcgaaaaacgcgcccgtatcgccgaatccgaaggtcgtaaaatcgaacaaatcaaccttgccagtggtcagcgcgaagccgaaatccaacaatccgaaggcgaggctcaggctgcggtcaatgcgtcaaatgccgagaaaatcgcccgcatcaaccgcgccaaaggtgaagcggaatccttgcgccttgttgccgaagccaatgccgaagccatccgtcaaattgccgccgcccttcaaacccaaggcggtgcggatgcggtcaatctgaagattgcggaacaatacgtcgctgcgttcaacaatcttgccaaagaaagcaatacgctgattatgcccgccaatgttgccgacatcggcagcctgatttctgccggtatgaaaattatcgacagcagcaaaaccgccaaataa

SEQ ID NO: 1456 - protein, 315 aa, Neisseria meningitidis
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 1457 - DNA, 948 bp, Neisseria meningitidis; identical to SEQ ID NO: 1451

SEQ ID NO: 1458 - protein, 315 aa, Neisseria meningitidis; identical to SEQ ID NO: 1452

SEQ ID NO: 1459 - DNA, 594 bp, Neisseria gonorrhoeae
atgcctgcgcttctttcaatacgtcgggcaaacgcgctgcctttttcgcgcatttcggaaaggatgaagttgctggtgccgttaataatgccggcgatggatttaatcctgtttgccgccaaaccttcgcgcacggctttgatgattgggataccgcccgctactgccgcttcaaattggacgatgacgttttgtttttccgccagcgggaagatttcgttgccgtattcggcgagcagttttttgttggcggtaacgatgtgtttgccgttttcaatggctttcaacaccgcttctttggcaatgcccgtgccgccgaacaattcgaccaagacatcgacgtctttacgcgcgaacagttcgaacggatcttttgacaagggcgggcgacgggccgattttggcgggctttttcttcgcttaagtcgcacatggcagaaatacggatttcgcgccccaagcggcgggaaatttcctctgcgttgtcccgcaacacggcagccgcaccgccgccgaccgtacctaagcctaaaagaccgatgtttactggcttcattgtgtctccttgtaagccgactgaaatgtaaatattga

SEQ ID NO: 1460 - protein, 197 aa, Neisseria gonorrhoeae
MPALLSIRRANALPFSRISERMKLLVPLIMPAMDLILFAAKPSRTALMIGIPPATAASNWTMTFCFSASGKISLPYSASSFLLAVTMCLPFSMAFNTASLAMPVPPNNSTKTSTSLRANSSNGSFDKGGRRADFGGLFLRLSRTWQKYGFRAPSGGKFPLRCPATRQPHRRRPYLSLKDRCLLASLCLLVSRLKCKY

SEQ ID NO: 1461 - DNA, 592 bp, Neisseria meningitidis
atgcctgcgcttctttcagtacatcggcaaacgcgctgcctttttcgcgcatttcggrkaggatgaagttgctggtgccgttaataatgccggcgatggatttaatcctgtttgccgccaaaccttcgcgcagggctttgatgattgggataccgcccgctactgccgcttcaaattggacgatgacgttttgtttttccgccagcgggaagatttcgttgccgtattcggcgagcagttttttgttggcggtaacgatgtgtttgccgttttcaatggctttcaacaccgcatctttggcaatgccggtaccgccgaacaattcgacgacgacatcgacgtcttcacgtgcgaccagttcgaacggatctttgacaaaggctgccggacgggcaggtttgtcgggctttttcttcactcaaatcgcacacggcagaaatacggatttcgcgccccaagcgacgggaaatttcctccgcgttgtcscgcaacacggcagccgtaccgccgccgaccgtacccaaacctaaaagaccgatgtttactggcttcattgtgtctccttgtaagccgactgaaatgtaaatattga

SEQ ID NO: 1462 - protein, 197 aa, Neisseria meningitidis
  misc_feature (9)..(9): Xaa can be any naturally occurring amino acid
  misc_feature (20)..(20): Xaa can be any naturally occurring amino acid
  misc_feature (129)..(129): Xaa can be any naturally occurring amino acid
  misc_feature (163)..(163): Xaa can be any naturally occurring amino acid
MPALLSVHXANALPFSRISXRMKLLVPLIMPAMDLILFAAKPSRRALMIGIPPATAASNWTMTFCFSASGKISLPYSASSFLLAVTMCLPFSMAFNTASLAMPVPPNNSTTTSTSSRATSSNGSLTKAXRTGRFVGLFLHSNRTRQKYGFRAPSDGKFPPRCXATRQPYRRRPYPNLKDRCLLASLCLLVSRLKCKY

SEQ ID NO: 1463 - DNA, 591 bp, Neisseria meningitidis
atgcctgcgcttctttcagtacatcggcaaacgcgctgcctttttcgcgcatttcggagaggatgaagttgctggtgccgttaataatgccggcgatggatttaatcctgtttgccgccaaaccttcgcgcagggctttgatgattgggataccgcccgctactgccgcttcaaattggacgatgacgttttgtttttccgccagcgggaagatttcgttgccgtattcggcgagcagttttttgttggcggtaacgatgtgtttgccgttttcaatggctttcaacaccgcatctttggcaatgccggtaccgccgaacaattcgacgacgacatcgacgtcttcacgtgcgaccagttcgaacggatctttgacaaaggctgcggacgggcaggtttgtcgggctttttcttcactcaaatcgcacacggcagaaatacggatttcgcgccccaagcgacgggaaatttcctccgcgttgtcccgcaacacggcagccgtaccgccgccgaccgtacccaaacctaaaagaccgatgtttactggcttcattgtgtctccttgtaagccgactgaaatgtaaatattga

SEQ ID NO: 1464 - protein, 197 aa, Neisseria meningitidis
  misc_feature (10)..(10): Xaa can be any naturally occurring amino acid
  misc_feature (129)..(129): Xaa can be any naturally occurring amino acid
MPALLSVHRXNALPFSRISERMKLLVPLIMPAMDLILFAAKPSRRALMIGIPPATAASNWTMTFCFSASGKISLPYSASSFLLAVTMCLPFSMAFNTASLAMPVPPNNSTTTSTSSRATSSNGSLTKAXRTGRFVGLFLHSNRTRQKYGFRAPSDGKFPPRCPATRQPYRRRPYPNLKDRCLLASLCLLVSRLKCKY

SEQ ID NO: 1465 - DNA, 522 bp, Neisseria gonorrhoeae
atgaagttgctggtgccgttaataatgccggcgatggatttaatcctgtttgccgccaaaccttcgcgcagggctttgatgattgggataccgcccgctactgccgcttcaaattggacgatgacgttttgtttttccgccagcgggaagatttcgttgccgtattcggcgagcagttttttgttggcggtaacgatgtgtttgccgttttcaatggctttcaacaccgcttctttggcaatgcccgtgccgccgaacaattcgacgacgacatcgacgtctttacgcgcgaccagttcgaacggatctttgacaaaggcggcggacgggcagatttggcgggctttttcttcgcttaagtcgcacatggcagaaatacggatttcgcgccccaagcggcgggaaatttcctctgcgttgtcccgcaacacggcagccgcaccgccgccgaccgtacctaagcctaaaagaccgatgtttactggcttcattgtgtctccttgtaagccgactgaaatgtaa

SEQ ID NO: 1466 - protein, 173 aa, Neisseria gonorrhoeae
MKLLVPLIMPAMDLILFAAKPSRRALMIGIPPATAASNWTMTFCFSASGKISLPYSASSFLLAVTMCLPFSMAFNTASLAMPVPPNNSTTTSTSLRATSSNGSLTKAADGQIWRAFSSLKSHMAEIRISRPKRREISSALSRNTAAAPPPTVPKPKRPMFTGFIVSPCKPTEM

SEQ ID NO: 1467 - DNA, 522 bp, Neisseria meningitidis
atgaagttgctggtgccgttaataatgccggcgatggatttaatcctgtttgccgccaaaccttcgcgcagggctttgatgattgggataccgcccgctactgccgcttcaaattggacgatgacgttttgtttttccgccagcgggaagatttcgttgccgtattcggcgagcagttttttgttggcggtaacgatgtgtttgccgttttcaatggctttcaacaccgcatctttggcaatgccggtaccgccgaacaattcgacgacgacatcgacgtcttcacgtgcgaccagttcgaacggatctttgacaaaggctgcggacgggcaggtttgtcgggctttttcttcactcaaatcgcacacggcagaaatacggatttcgcgccccaagcgacgggaaatttcctccgcgttgtcccgcaacacggcagccgtaccgccgccgaccgtacccaaacctaaaagaccgatgtttactggcttcattgtgtctccttgtaagccgactgaaatgtaa

SEQ ID NO: 1468 - protein, 173 aa, Neisseria meningitidis
MKLLVPLIMPAMDLILFAAKPSRRALMIGIPPATAASNWTMTFCFSASGKISLPYSASSFLLAVTMCLPFSMAFNTASLAMPVPPNNSTTTSTSSRATSSNGSLTKAADGQVCRAFSSLKSHTAEIRISRPKRREISSALSRNTAAVPPPTVPKPKRPMFTGFIVSPCKPTEM

SEQ ID NO: 1469 - DNA, 522 bp, Neisseria meningitidis; identical to SEQ ID NO: 1467

SEQ ID NO: 1470 - protein, 173 aa, Neisseria gonorrhoeae; identical to SEQ ID NO: 1468

SEQ ID NO: 1471 - DNA, 513 bp, Neisseria gonorrhoeae
atgaaatcaaaactccccttaatcctaatcaacctttccctgatttcaagcccattgggtgcgaatgcggccaaaatctatacctgcacaatcaacggagaaaccgtttacaccaccaagccgtctaaaagctgccactcaaccgatttgcccccaatcggcaactacagcagcgaacgctatatcctgccccaaactcccgaaccggcaccatcaccgtcaaacggcggacaggctgtcaaatataaagccccggtcaaaacagtatccaagccggcaaaatccaatacgccgcctcaacaagcacctgtaaataacagcagacgctccattctcgaagcagaattaagcaatgaacgcaaagccctgactgaagcccaaaaaatgttatcacaagcacgtctggcaaaaggcggcaacatcaaccatcaaaaaatcaacgcattgtaaagcaatgttttggacagacagcaaaatatccaagcactgcaaagagaattgggacgtatgtaa

SEQ ID NO: 1472 - protein, 169 aa, Neisseria meningitidis
MKSKLPLILINLSLISSPLGANAAKIYTCTINGETVYTTKPSKSCHSTDLPPIGNYSSERYILPQTPEPAPSPSNGGQAVKYKAPVKTVSKPAKSNTPPQQAPVNNSRRSILEAELSNERKALTEAQKMLSQARLAKGGNINHQKINALSNVLDRQQNIQALQRELGRM

SEQ ID NO: 1473 - DNA, 516 bp, Neisseria meningitidis
atgaaatcaaaactcctcttaatcctaatcaacttttccctgatttcaagcccattgggtgcgaatgcggccaaaatctasacctgcacaatcaacggagaaaccgtttacaccascaagccgtccaaaagctgccactcaaccgatttgcccccaatcggcaactacagcagcgaacgctatatcccgccccaaacgcccgaaccggtatcatcaccgtcaaacggcggacwggttgtcaaatataaagccccggtcaaaacagtatccaagccggcaaaatccartacgccgccgccgcaacaagcaccctcaaacaacagcagacgctccattctcgaaacagaattgagcaacgaacgcaaagcattggttgaagcccaaaaaatgttatcacaagcacgtctggcaaagggcggcaacatcaaccatcaagaaataaatgcattacaaagcaatgtattggacaggcagcaaaatattcaagccctgcaaagggaactggggcgtatgtaa

SEQ ID NO: 1474 - protein, 171 aa, Neisseria meningitidis
  misc_feature (27)..(27): Xaa can be any naturally occurring amino acid
  misc_feature (39)..(39): Xaa can be any naturally occurring amino acid
  misc_feature (78)..(78): Xaa can be any naturally occurring amino acid
  misc_feature (96)..(96): Xaa can be any naturally occurring amino acid
MKSKLLLILINFSLISSPLGANAAKIXTCTINGETVYTXKPSKSCHSTDLPPIGNYSSERYIPPQTPEPVSSPSNGGXVVKYKAPVKTVSKPAKSXTPPPQQAPSNNSRRSILETELSNERKALVEAQKMLSQARLAKGGNINHQEINALQSNVLDRQQNIQALQRELGRM

SEQ ID NO: 1475 - DNA, 516 bp, Neisseria meningitidis
atgaaatcaaaactccccttaatcctaatcaacttttccctgatttcaagcccattgggtgcgaatgcggccaaaatctacacctgcacaatcaacggagaaaccgtttacaccaccaagccgtccaaaagctgcctctcaaccgatttgcccccaatcggcaactacagcagcgaacgctatatcccgccccaaacatccgaaccgacaccatcaccgtcaaacggcggacaggctgtcaaatataaagccccggtcaaaacagtatccaagccggcaaaatccaatacgccgccgccgcaacaagcaccctcaaacaacagcagacgctccattctcgaaacagaattgagcaacgaacgcaaagcattggttgaagcccaaaaaatgttatcacaagcacgtctggcaaaaggcggcaacatcaaccatcaagaaatcaacgcattgcaaagcaatgtattggacaggcagcaaaatatccaagcactgcaaagagaattgggacgtatgtaa

SEQ ID NO: 1476 - protein, 170 aa, Neisseria gonorrhoeae
MKSKLPLILINFSLISSPLGANAAKIYTCTINGETVYTTKPSKSCLSTDLPPIGNYSSERYIPPQTSEPTPSPSNGGQAVKYKAPVKTVSKPAKSNTPPPQQAPSNNSRRSILETELSNERKALVEAQKMLSQARLAKGGNINHQEINALQSVLDRQQNIQALQRELGRM

SEQ ID NO: 1477 - DNA, 435 bp, Neisseria gonorrhoeae
atgactgagccgaaacacgaaacgccgacggaagagcaggttgccgcgcgcaaaaaagcaaaagccaaaatccgcaccatccgcatttgggcgtgggtcattttggcgttgctcgcttcaaccgccctgctctcccaatgcgcgatgtccaaaccgcaggcaaaacagaaaattgtcgagtcttgcatgaaaaatattccgtttgctgaaaaatggcagaacgatttgaaagcgcgcggcttggatgcggacaatacccgtctcgccgtcgactactgcaaatgtatgtgggagcagcctttggacggattgagcgagaaacagatcagctccttcggcaaactcggtgcacaagaacagcttgacctgctcggcggcgcaaacgcgtttgaaactcgagacaaacaatgtgtcgcggatttgaaagccgattga

SEQ ID NO: 1478 - protein, 144 aa, Neisseria meningitidis
MTEPKHETPTEEQVAARKKAKAKIRTIRIWAWVILALLASTALLSQCAMSKPQAKQKIVESCMKNIPFAEKWQNDLKARGLDADNTRLAVDYCKCMWEQPLDGLSEKQISSFGKLGAQEQLDLLGGANAFETRDKQCVADLKAD

SEQ ID NO: 1479 - DNA, 435 bp, Neisseria meningitidis
atgactgagccgaaacacgaaatgctgacgaaagagcaggttgccgcgcgcaaaaaagcaaaagccaaaatccgcaccatccgcatttgggcgtgggtcattttggcgttgctcgctttaaccgccctgctctcccaatgcgcgatgtccaaaccgcaggcaaaacagaaaattgtcgagtcttgcgtgaagaatattccgtttgccgaaaaatggcaaaacgatttgcgggcccgcggtttagattcaaacaatacccgcctcgccgtcgactactgcaaatgtatgtgggagcagcctttggacagattgagcgagaaacagattagatccttcggcaaactcggcgcacaagaacagcttgacctgctcggcggcgcaaatgcctttgaagcacgtgacaagcagtgtgttgccgatttgaaatcagaataa

SEQ ID NO: 1480 - protein, 144 aa, Neisseria meningitidis
MTEPKHEMLTKEQVAARKKAKAKIRTIRIWAWVILALLALTALLSQCAMSKPQAKQKIVESCVKNIPFAEKWQNDLRARGLDSNNTRLAVDYCKCMWEQPLDRLSEKQIRSFGKLGAQEQLDLLGGANAFEARDKQCVADLKSE

SEQ ID NO: 1481 - DNA, 435 bp, Neisseria meningitidis
atgactgagccgaaacacgaaatgccgacggaagagcaggttgccgcgcgcaaaaaagcaaaagccaaaatccgcaccatccgcatttgggcatgggtcattttggcgttgctcgcttcaaccgccctgctctcccaatgcgcgatgtccaaaccgcaggcaaaacagaaaattgtcgagtcttgcgtgaagaatattccgtttgccgaaaaatggcaaaacgatttgcgggcccgcggtttagattcaaacaatacccgccttaccgtcgactactgcaaatgtatgtgggagcagcctttggacagattgagcgagaaacagattagttccttcggcaaactcggcgcacaagaacagcttgacctgctcggcggcgcaaatgcctttgaaacgcgagacaagcagtgtgttgccgatttgaaatcagaataa

SEQ ID NO: 1482 - protein, 144 aa, Neisseria gonorrhoeae
MTEPKHEMPTEEQVAARKKAKAKIRTIRIWAWVILALLASTALLSQCAMSKPQAKQKIVESCVKNIPFAEKWQNDLRARGLDSNNTRLTVDYCKCMWEQPLDRLSEKQISSFGKLGAQEQLDLLGGANAFETRDKQCVADLKSE

SEQ ID NO: 1483 - DNA, 408 bp, Neisseria gonorrhoeae
atgactgtatggtttgttgccgctgttgccgtcttaatcatcgaattattgacgggaacggtttatcttttggttgtcagcgcggctttggcgggttcgggcattgcctacgggctgactggcagcacgcctgccgccgtcttgaccgccgcactgctttccgcgctgggcatttggttcgtacatgccaaaaccgccgtgggaaaagttgaaacggattcatatcaggatttggataccggaaaatatgccgaaatcctccgatacacaggcggcaaccgttacgaagttttttatcgcggtacgcactggcaggcgcaaaatacggggcaggaagtgtttgaaccgggaacgcgcgccctcatcgtccgcaaagaaggtaaccttcttatcatcgcaaacccttaa

SEQ ID NO: 1484 - protein, 135 aa, Neisseria meningitidis
MTVWFVAAVAVLIIELLTGTVYLLVVSAALAGSGIAYGLTGSTPAAVLTAALLSALGIWFVHAKTAVGKVETDSYQDLDTGKYAEILRYTGGNRYEVFYRGTHWQAQNTGQEVFEPGTRALIVRKEGNLLIIANP

SEQ ID NO: 1485 - DNA, 381 bp, Neisseria meningitidis
  misc_feature (51)..(51): n is a, c, g, or t
  misc_feature (122)..(122): n is a, c, g, or t
  misc_feature (149)..(149): n is a, c, g, or t
gccgtcttaatcatcgaattattgacgggaacggtttatcttttggttgtnagcgcggctttggcgggttcgggcattgcttacgggctgaccggcagtacgcctgccgccgtcttgaccgncgctctgctttccgcgctgggtatttngttcgtacacgccaaaaccgccgttagaaaagttgaaacggattcatatcaggatttggatgccggacaatatgtcgaaatcctccgacacacaggcggcaaccgttacgaagttttttatcgcggtacgcactggcaggctcaaaatacggggcaagaagagcttgaaccaggaactcgcgccctcattgtccgcaaggaaggcaaccttcttattatcacacacccttaa

SEQ ID NO: 1486 - protein, 126 aa, Neisseria meningitidis
  misc_feature (41)..(41): Xaa can be any naturally occurring amino acid
  misc_feature (50)..(50): Xaa can be any naturally occurring amino acid
AVLIIELLTGTVYLLVVSAALAGSGIAYGLTGSTPAAVLTXALLSALGIXFVHAKTAVRKVETDSYQDLDAGQYVEILRHTGGNRYEVFYRGTHWQAQNTGQEELEPGTRALIVRKEGNLLIITHP

SEQ ID NO: 1487 - DNA, 408 bp, Neisseria meningitidis
atgactgtatggtttgttgccgctgttgccgtcttaatcatcgaattattgacgggaacggtttatcttttggttgtcagcgcggctttggcgggttcgggcattgcttacgggctgaccggcagcacgcctgccgccgtcttgaccgccgctctgctttccgcgctgggtatttggttcgtacacgccaaaaccgccgtgggaaaagttgaaacggattcatatcaggatttggatgccgggcaatatgccgaaatcctccggcacgcaggcggcaaccgttacgaagttttttatcgcggtacgcactggcaggctcaaaatacggggcaagaagagcttgaaccaggaacgcgcgccctaatcgtccgcaaggaaggcaaccttcttatcatcgcaaaaccttaa

SEQ ID NO: 1488 - protein, 135 aa, Neisseria gonorrhoeae
MTVWFVAAVAVLIIELLTGTVYLLVVSAALAGSGIAYGLTGSTPAAVLTAALLSALGIWFVHAKTAVGKVETDSYQDLDAGQYAEILRHAGGNRYEVFYRGTHWQAQNTGQEELEPGTRALIVRKEGNLLIIAKP

SEQ ID NO: 1489 - DNA, 561 bp, Neisseria gonorrhoeae
atgaagtacgtccggttatttttcctcggcacggcactcgccggcactcaagcggcggctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgaattgaaacagccggttaccaatatttcctggtttgccgccaacgcctattgcgccgcacaaggcaaacgcctgccgaccatcgacgaatgggaatttgccggacttgcttccgccacgcagaaaaaacggctcaaacgaacccggctacaaccgcactattctcgattggtatgccgacggcggacggaaaggcctgcacgatgtcggcaaagcaccgcccgaactactggggtgtttatgatatgcacgggctga

SEQ ID NO: 1490 - protein, 186 aa, Neisseria meningitidis
MKYVRLFFLGTALAGTQAAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNISWFAANAYCAAQGKRLPTIDEWEFAGLASATQKKRLKRTRLQPHYSRLVCRRRTERPARCRQSTARTTGVFMICTG

SEQ ID NO: 1491 - DNA, 559 bp, Neisseria meningitidis
atgaagtatgtccggttattttwcctcggcgcggcactcgccrrcactcaarcggcggctgccgaaatggttcaaatcgaaggcggcagctaccgcccrctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgaattaaaacaaccggtaaccaatgtttcctggwttgccgccaacgcctattgcgccgcacaaggcaaacgcctgccgaccattgacgaatgggaatttgccggacttgcttccgccacgcagaaaaacggctcaaacgaacccggctacaaccgcactattctcgattggtatgccgacggcggacggaaaggcctgcacgatgtcggcaaaggccgcccgaactactggggcgtttatgatatgcacgggctga

SEQ ID NO: 1492 - protein, 186 aa, Neisseria meningitidis
  misc_feature (8)..(8): Xaa can be any naturally occurring amino acid
  misc_feature (15)..(15): Xaa can be any naturally occurring amino acid
  misc_feature (18)..(18): Xaa can be any naturally occurring amino acid
  misc_feature (113)..(113): Xaa can be any naturally occurring amino acid
  misc_feature (144)..(144): Xaa can be any naturally occurring amino acid
  misc_feature (172)..(172): Xaa can be any naturally occurring amino acid
MKYVRLFXLGAALAXTQXAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNVSWXAANAYCAAQGKRLPTIDEWEFAGLASATQKXRLKRTRLQPHYSRLVCRRRTERPARCRXKAARTTGAFMICTG

SEQ ID NO: 1493 - DNA, 559 bp, Neisseria meningitidis
atgaagtttacccggttactctttctctgtgcggcactcgccggcactcaagcggcagctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgatttaaaacaaccggtaaccaatgtttcctggttcgccgccaacgcctattgcgccgcacaaggcaaacgcctgccgaccattgacgaatgggaatttgccggacttgcctccgccacgcagaaaaacggctcaaacgaacccggctacaaccgcactattctcgactggtatgcggatggcgaccggaaagacctgcacgatgtcggcaaaggtcgcccgaactactggggcgtttatgatatgcacggtctga

SEQ ID NO: 1494 - protein, 186 aa, Neisseria gonorrhoeae
  misc_feature (143)..(143): Xaa can be any naturally occurring amino acid
  misc_feature (173)..(173): Xaa can be any naturally occurring amino acid
MKFTRLLFLCAALAGTQAAAAEMVQIEGGSYRPLYLKKDTGLIKVKPFKLDKYPVTNAEFAEFVNSHPQWQKGRIGSKQAEPAYLKHWMKNGSRSYAPKAGDLKQPVTNVSWFAANAYCAAQGKRLPTIDEWEFAGLASATQXKRLKRTRLQPHYSRLVCGWRPERPARCRQXVARTTGAFMICTV

SEQ ID NO: 1495 - DNA, 756 bp, Neisseria gonorrhoeae
atgaagtacgtccggttatttttcctcggcacggcactcgccggcactcaagcggcggctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgaattgaaacagccggttaccaatatttcctggtttgccgccaacgcctattgcgccgcacaaggcaaacgcctgccgaccatcgacgaatgggaatttgccggacttgcttccgccacgcagaaaaacggctcaaacgaacccggctacaaccgcactattctcgattggtatgccgacggcggacggaaaggcctgcacgatgtcggcaaagaccgcccgaactactggggtgtttatgatatgcacgggctgatttgggaatggacggaagatttcaacagcagcctgctttcttccggcaatgccaacgcgcaaatgttttgcagcggcgcatctgtcggggcgagcgactcgtccaactatgccgccttcctccgctacggcatccgcaccagcctgcaatccaaatacgtcctgcacaacttgggcttccgctgcgcaagccgataa

SEQ ID NO: 1496 - protein, 251 aa, Neisseria meningitidis
MKYVRLFFLGTALAGTQAAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNISWFAANAYCAAQGKRLPTIDEWEFAGLASATQKNGSNEPGYNRTILDWYADGGRKGLHDVGKDRPNYWGVYDMHGLIWEWTEDFNSSLLSSGNANAQMFCSGASVGASDSSNYAAFLRYGIRTSLQSKYVLHNLGFRCASR

SEQ ID NO: 1497 - DNA, 756 bp, Neisseria meningitidis
atgaagtatgtccggttatttttcctcggcgcggcactcgccggcactcaagcggcggctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgaattaaaacaaccggtaaccaatgtttcctggtttgccgccaacgcctattgcgccgcacaaggcaaacgcctgccgaccattgacgaatgggaatttgccggacttgcttccgccacgcagaaaaacggctcaaacgaacccggctacaaccgcactattctcgattggtatgccgacggcggacggaaaggcctgcacgatgtcggcaaaggccgcccgaactactggggcgtttatgatatgcacgggctgatttgggaatggacggaagatttcaacagcagcctgctttcttccggcaatgccaacgcgcaaatgttttgcagcggcgcgtctatcgggtcgagcgactcgtccaactatgccgccttcctccgctacggcatccgtaccagcctgcaatccaaatatgtcttgcacaacttgggcttccgttgcacaagccgataa

SEQ ID NO: 1498 - protein, 251 aa, Neisseria meningitidis
MKYVRLFFLGAALAGTQAAAAEMVQIEGGSYRPLYLKKDTGLIKVKPFKLDKYPVTNAEFAEFVNSHPQWQKGRIGSKQAEPAYLKHWMKNGSRSYAPKAGELKQPVTNVSWFAANAYCAAQGKRLPTIDEWEFAGLASATQKNGSNEPGYNRTILDWYADGGRKGLHDVGKGRPNYWGVYDMHGLIWEWTEDFNSSLLSSGNANAQMFCSGASIGSSDSSNYAAFLRYGIRTSLQSKYVLHNLGFRCTSR

SEQ ID NO: 1499 - DNA, 756 bp, Neisseria meningitidis
atgaagtttacccggttactctttctctgtgcggcactcgccggcactcaagcggcagctgccgaaatggttcaaatcgaaggcggcagctaccgcccgctttatctgaaaaaagataccggcctgattaaagtcaaaccgttcaaactggataaatatcccgttaccaatgccgagtttgccgaatttgtcaacagccacccccaatggcaaaaaggcaggatcggttccaaacaggcagaacccgcttacctgaagcattggatgaaaaacggcagccgcagctatgcgccgaaggcgggcgatttaaaacaaccggtaaccaatgtttcctggttcgccgccaacgcctattgcgccgcacaaggcaaacgcctgccgaccattgacgaatgggaatttgccggacttgcctccgccacgcagaaaaacggctcaaacgaacccggctacaaccgcactattctcgactggtatgcggatggcgaccggaaagacctgcacgatgtcggcaaaggtcgcccgaactactggggcgtttatgatatgcacggtctgatttgggaatggacggaagatttcaacagcagcctgctttcttccggcaatgccaacgcgcaaatgttttgcagcggcgcgtctatcgggtcgagcgactcgtccaactatgccgccttcctccgctacggcatccgcaccagcctgcaatccaaatatgtcttgcacaacttgggcttccgttgcacaagccgataa

SEQ ID NO: 1500 - protein, 251 aa, Neisseria gonorrhoeae
MKFTRLLFLCAALAGTQAAAAEMVQIEGGSYRPLYLKKDTGLIKVKPFKLDKYPVTNAEFAEFVNSHPQWQKGRIGSKQAEPAYLKHWMKNGSRSYAPKAGDLKQPVTNVSWFAANAYCAAQGKRLPTIDEWEFAGLASATQKNGSNEPGYNRTILDWYADGDRKDLHDVGKGRPNYWGVYDMHGLIWEWTEDFNSSLLSSGNANAQMFCSGASIGSSDSSNYAAFLRYGIRTSLQSKYVLHNLGFRCTSR

SEQ ID NO: 1501 - DNA, 453 bp, Neisseria gonorrhoeae
atggttttaccagtctccttttttcagcctgtccagttggcggcggtcgcgcttggtcggtctgccgtcgggatgggcggaagtgatgcggctgaattggtcgagctgtttgcactcttccctcaatgctgccgttttcgcgtcttcttcatacagaagccgcgcctcgggtgccgggcggcgttggtggttcaaacctttaaccttgattttatggggaagggaattgagcgtcaggtcgataatatcgccgatgtctatggttttactgtttttgactttcgagccgtttacttgaaccctacccagttcgatatgcttttgcgcaagggaacgggtcttgaaaaaacgtgccgcccaaagccatttgtccagccgcatggcggaagaatcgtgcttgtctttcatacgattttgtttgaaataattgaatttgtttcgagtttagcataa

SEQ ID NO: 1502 - protein, 150 aa, Neisseria gonorrhoeae
MVLPVSFFQPVQLAAVALGRSAVGMGGSDAAELVELFALFPQCCRFRVFFIQKPRLGCRAALVVQTFNLDFMGKGIERQVDNIADVYGFTVFDFRAVYLNPTQFDMLLRKGTGLEKTCRPKPFVQPHGGRIVLVFHTILFEIIEFVSSLA

SEQ ID NO: 1503 - DNA, 452 bp, Neisseria meningitidis
atggttttaccagtctccttttttcagcctgtccagttggcggcggtcgcgcttggtcggtctgccgtcgggataggcggaagtgatgcggctgaattggtcgagctgtttgcgctcttccctcaatgttgccgttwtcgcgtcctcttcatacagaagccgcgcytcggatgccgggcggcgttggtggttcaaacctttaaccktgattttatagggaagggaattkagcktcagtygrtwatatcgcsgatgtmtatggttttactgtttttgaccttcgagccgtttacttgaaccctacccagttcgatgtgcttttgcgcaagggaacgggtcttgaaaaaacgtgccgcccaaagccatttgtccagccgcatggcggaagaatcgtgcttgtctttcatacgattttgtttgaaataattgaatttgtttcgagtttagcataa

SEQ ID NO: 1504 - protein, 150 aa, Neisseria meningitidis
  misc_feature (46)..(46): Xaa can be any naturally occurring amino acid
  misc_feature (56)..(56): Xaa can be any naturally occurring amino acid
  misc_feature (69)..(69): Xaa can be any naturally occurring amino acid
  misc_feature (75)..(75): Xaa can be any naturally occurring amino acid
  misc_feature (77)..(77): Xaa can be any naturally occurring amino acid
  misc_feature (81)..(82): Xaa can be any naturally occurring amino acid
MVLPVSFFQPVQLAAVALGRSAVGIGGSDAAELVELFALFPQCCRXRVLFIQKPRXGCRAALVVQTFNXDFIGKXNXASVXXIADVYGFTVFDLRAVYLNPTQFDVLLRKGTGLEKTCRPKPFVQPHGGRIVLVFHTILFEIIEFVSSLA

SEQ ID NO: 1505 - DNA, 453 bp, Neisseria meningitidis
atggttttaccagtctccttttttcagcctgtccagttggcggcggtcgcgcttggtcggtctgccgtcgggataggcggaagtgatgcggctgaattggtcgagctgtttgcgctcttccctcaatgttgccgttttcgcgtcctcttcatacagaagccgcgcctcggatgccgggcggcgttggtggttcaaacctttaaccttgattttatagggaagggaattgagcgtcaggtcgataatatcgccgatgtctatggttttactgtttttgaccttcgagccgtttacttgaaccctacccagttcgatgtgcttttgcgcaagggaacgggtcttgaaaaaacgtgccgcccaaagccatttgtccagccgcatggcggaagaatcgtgcttgtctttcatacgattttgtttgaaataattgaatttgtttcgagtttagcataa

SEQ ID NO: 1506 - protein, 150 aa, Neisseria meningitidis
MVLPVSFFQPVQLAAVALGRSAVGIGGSDAAELVELFALFPQCCRFRVLFIQKPRLGCRAALVVQTFNLDFIGKGIERQVDNIADVYGFTVFDLRAVYLNPTQFDVLLRKGTGLEKTCRPKPFVQPHGGRIVLVFHTILFEIIEFVSSLA

SEQ ID NO: 1507 - DNA, 408 bp, Neisseria gonorrhoeae
atggaaattcgggtaataaaatatacggcaacggctgcgttgtttgcatttacggttgcaggctgccggctggcggggtggtatgagtgtttgtccttgtccggctggtgtaagccgagaaaacctgccgccatcgatttttgggatattggcggcgagagtccgctgtctttagaggactacgagataccgctttcagacggcaatcgttccgtcagggcaaacgaatatgaatccgcgcaaaaatcttacttttataggaaaatagggaagtttgaagcctgcgggttggattggcgtacgcgtgacggcaaacctttggttgagaggttcaaacaggaaggtttcgactgtttggaaaagcaggggttgcggcgcaacggcctgtccgagcgcgtccgatggtaa

SEQ ID NO: 1508 - protein, 135 aa, Neisseria gonorrhoeae
MEIRVIKYTATAALFAFTVAGCRLAGWYECLSLSGWCKPRKPAAIDFWDIGGESPLSLEDYEIPLSDGNRSVRANEYESAQKSYFYRKIGKFEACGLDWRTRDGKPLVERFKQEGFDCLEKQGLRRNGLSERVRW

SEQ ID NO: 1509 - DNA, 362 bp, Neisseria meningitidis
atggaaattcgggcaataaaatatacggcaatggctgcgttgcttgcatttacggttgcaggctgccggctggcggggtggtatgagtgttcgtccctcaccggctggtgtaagccgagaaaaccggctgccatcgatttttgggatattggcggcgagagtccgccgtctttaggggactacgagataccgctttcagacggcaatagttccgtcagggcaaacgaatatgaatccgcacaacaatcttacttttacaggaaaatagggaagtttgaagctgcgggctggattggcgtacgcgtgacggcaaacctttgattgagacgttcaaacagggaggatttgactgcttggaaaag

SEQ ID NO: 1510 - protein, 121 aa, Neisseria meningitidis
  misc_feature (94)..(94): Xaa can be any naturally occurring amino acid
MEIRAIKYTAMAALLAFTVAGCRLAGWYECSSLTGWCKPRKPAAIDFWDIGGESPPSLGDYEIPLSDGNSSVRANEYESAQQSYFYRKIGKFEXCGLDWRTRDGKPLIETFKQGGFDCLEK

SEQ ID NO: 1511 - DNA, 408 bp, Neisseria meningitidis
atggaaattcgggcaataaaatatacggcaatggctgcgttgcttgcatttacggttgcaggctgccggttggcaggttggtatgagtgttcgtccctgtccggctggtgtaagccgagaaaacctgccgccatcgatttttgggatattggcggcgagagtcctccgtctttagaggactacgagataccgctttcagacggcaatcgttccgtcagggcaaacgaatatgaatccgcacaacaatcttacttttacaggaaaatagggaagtttgaagcctgcgggttggattggcgtacgcgtgacggcaaacctttgattgagacgttcaaacaggaaggttttgattgtttgaaaaagcaggggttgcggcgcaacggtctgtccgagcgcgtccgatggtaa

SEQ ID NO: 1512 - protein, 135 aa, Neisseria meningitidis
MEIRAIKYTAMAALLAFTVAGCRLAGWYECSSLSGWCKPRKPAAIDFWDIGGESPPSLEDYEIPLSDGNRSVRANEYESAQQSYFYRKIGKFEACGLDWRTRDGKPLIETFKQEGFDCLKKQGLRRNGLSERVRW

SEQ ID NO: 1513 - DNA, 408 bp, Neisseria gonorrhoeae
atggaaattcgggtaataaaatatacggcaacggctgcgttgtttgcatttacggttgcaggctgccggctggcggggtggtatgagtgttcgtccttgtccggctggtgtaagccgagaaaacctgccgccatcgatttttgggatattggcggcgagagtccgctgtctttagaggactacgagataccgctttcagacggcaatcgttccgtcagggcaaacgaatatgaatccgcgcaaaaatcttacttttataggaaaatagggaagtttgaagcctgcgggttggattggcgtacgcgtgacggcaaacctttggttgagaggttcaaacaggaaggtttcgactgtttggaaaagcaggggttgcggcgcaacggcctgtccgagcgcgtccgatggtaa

SEQ ID NO: 1514 - protein, 135 aa, Neisseria gonorrhoeae
MEIRVIKYTATAALFAFTVAGCRLAGWYECSSLSGWCKPRKPAAIDFWDIGGESPLSLEDYEIPLSDGNRSVRANEYESAQKSYFYRKIGKFEACGLDWRTRDGKPLVERFKQEGFDCLEKQGLRRNGLSERVRW

SEQ ID NO: 1515 - DNA, 408 bp, Neisseria meningitidis
atggaaattcgggcaataaaatatacggcaatggctgcgttgcttgcatttacggttgcaggctgccggctggcggggtggtatgagtgttcgtccctcaccggctggtgtaagccgagaaaaccggctgccatcgatttttgggatattggcggcgagagtccgccgtctttaggggactacgagataccgctttcagacggcaatcgttccgtcagggcaaacgaatatgaatccgcacaacaatcttacttttacaggaaaatagggaagtttgaagcctgcgggctggattggcgtacgcgtgacggcaaacctttgattgagacgttcaaacagggaggatttgactgcttggaaaagcaggggttgcggcgcaacggtctgtccgagcgcgtccgatggtaa

SEQ ID NO: 1516 - protein, 135 aa, Neisseria meningitidis
MEIRAIKYTAMAALLAFTVAGCRLAGWYECSSLTGWCKPRKPAAIDFWDIGGESPPSLGDYEIPLSDGNRSVRANEYESAQQSYFYRKIGKFEACGLDWRTRDGKPLIETFKQGGFDCLEKQGLRRNGLSERVRW

SEQ ID NO: 1517 - DNA, 408 bp, Neisseria meningitidis; identical to SEQ ID NO: 1511

SEQ ID NO: 1518 - protein, 135 aa, Neisseria meningitidis; identical to SEQ ID NO: 1512

SEQ ID NO: 1519 - DNA, 359 bp, Neisseria gonorrhoeae
atgacccatatcaaacccgtcattgccgcgctcgcactcatcgggcttgccgcctgctccggcagcaaaaccgaacagcccaagctcgactaccaaagccggtcgcaccgcctgatcaaactcgaagtcccgcctgatttgaacaaccccgaccaaggcaacctctaccgcctgcctgccggttcgggagccgtccgcgccggggatttggaaaaacgccgcacacccgccgtccaacagccagcggatgccggaagtattgaaaagcgtcaaaggcgtccgcttcgagcggcgacggcagccaacgcctggcttgtcgttgacggcaaatcccccgccgaaatctccgccgctttctg

SEQ ID NO: 1520 - protein, 119 aa, Neisseria gonorrhoeae
MTHIKPVIAALALIGLAACSGSKTEQPKLDYQSRSHRLIKLEVPPDLNNPDQGNLYRLPAGSGAVRAGDLEKRRTPAVQQPADAGSIEKRQRRPLRAATAANAWLVVDGKSPAEISAAF

SEQ ID NO: 1521 - DNA, 1128 bp, Neisseria meningitidis
atgacccatatcaaacccgtcattgccgcgctcgcactcatcgggcttgccgcctgctccggcagcaaaaccgaacagcccaagctcgactaccaaagccggtcgcaccgcctgatcaaacttgaagtcccacctgatttgaacaaccccgaccaaggcaacctctaccgcctgcctgccggttcgggcgccgtccgcgccagcgatttggaaaaacgccgcacacccgccgtccaacagcctgccgatgccgaagtattgaaaagcgtcaaaggtgtccgcctcgagcgcgacggcagccaacgctggctcgttgtcgacggcaagtctcctgccgaaatctggccgctcctgaaagccttttggcaggaaaacggcttcgacatcaaatccgaagaacccgccatcggacaaatggaaaccgagtgggcggaaaaccgcgccaaaatcccccaagacagcttgcgccgcctcttcgacaaagtcggcttgggcggcatctactccaccggcgagcgcgacaaattcatcgtccgtatcgaacagggcaaaaacggcgtttccgacatcttcttcgcccacaaagccatgaaagaagtgtacggcggcaaagacaaagacacgaccgtatggcagccctccccgtccgatcccaacctcgaagccgctttcctgacgcgctttatgcaatatttgggcgttgacggacagcaggcggaaaacgcatcggcaaaaaaacctacccttcccgccgccaacgaaatggcgcgtatcgaaggcaaaagcctgattgtctttggcgactacggcagaaactggcggcgcaccgtgctcgccctcgaccgcatcgggctgaccgtcgtcggtcaaaacaccgaacgccacgccttcctggttcaaaaagccccgaacgaaagcaatgcagttaccgaacaaaaacccggcctgttcaaacgcctgctgggcaaaggcaaagcggagaaacctgccgaacagccggaactgattgtctatgcagaacctgtcgccaacggctcgcgcatcgtcctgctcaacaaagacggcagcgcatatgccggcaaagacgcatccgcattattgggcaaactccattccgaactgcgttaa

SEQ ID NO: 1522 - protein, 375 aa, Neisseria meningitidis
MTHIKPVIAALALIGLAACSGSKTEQPKLDYQSRSHRLIKLEVPPDLNNPDQGNLYRLPAGSGAVRASDLEKRRTPAVQQPADAEVLKSVKGVRLERDGSQRWLVVDGKSPAEIWPLLKAFWQENGFDIKSEEPAIGQMETEWAENRAKIPQDSLRRLFDKVGLGGIYSTGERDKFIVRIEQGKNGVSDIFFAHKAMKEVYGGKDKDTTVWQPSPSDPNLEAAFLTRFMQYLGVDGQQAENASAKKPTLPAANEMARIEGKSLIVFGDYGRNWRRTVLALDRIGLTVVGQNTERHAFLVQKAPNESNAVTEQKPGLFKRLLGKGKAEKPAEQPELIVYAEPVANGSRIVLLNKDGSAYAGKDASALLGKLHSELR

SEQ ID NO: 1523 - DNA, 1128 bp, Neisseria meningitidis
atgacccatatcaaacccgtcattgccgcgctcgcactcatcgggcttgccgcctgctccggcagcaaaaccgaacagcccaagctcgactaccaaagccggtcgcaccgcctgatcaaactcgaagtcccacctgatttgaacaaccccgaccaaggcaacctctaccgcctgcctgccggttcgggcgccgtccgcgccagcgatttggaaaaacgccgcacacccgccgtccaacagcctgccgatgccgaagtattgaaaagcgtcaaaggtgtccgcctcgagcgcgacggcagccaacgctggctcgttgtcgacggcaagtctcatgccgaaatctggccgctcctgaaagccttttggcaggaaaacggcttcgacatcaaatccgaagaacccgccatcggacaaatggaaaccgagtgggcggaaaaccgtgccaaaatcccccaagacagcttgcgccgcctattcgacacagtcggtttgggcggcatctactccaccggcgagcgcgacaaattcatcgtccgtatcgaacagggcaaaaacggcgtttccgacatcttcttcgcccacaaagccatgaaagaagtgtacggcggcaaagacaaagacacgaccgtatggcagccctccccgtccgatcccaacctcgaagccgctttcctgacgcgctttatgcaatatttgggcgttgacggacagcaggcggaaaacgcatcggcaaaaaaacctacccttcccgccgccaacgaaatggcgcgtatcgaaggcaaaagcctgattgtctttggcgactacggcagaaactggcggcgcaccgcgctcgccctcgaccgcatcgggctgaccgtcgtcggtcaaaacaccgaacgccacgctttcctggttcaaaaagccccgaacgaaagcaatgcagttaccgaacaaaaacccggcctgttcaaacgcctgctgggcaaaggcaaagcggagaaacctgccgaacagccggaactgattgtctatgccgagcctgtcgccaacggctcgcgcatcgtcctgctcaacaaagacggcagcgcatatgccggcaaagacgcatccgcattattgggcaaactccattccgaactgcgttaa

SEQ ID NO: 1524 - protein, 375 aa, Neisseria meningitidis
MTHIKPVIAALALIGLAACSGSKTEQPKLDYQSRSHRLIKLEVPPDLNNPDQGNLYRLPAGSGAVRASDLEKRRTPAVQQPADAEVLKSVKGVRLERDGSQRWLVVDGKSHAEIWPLLKAFWQENGFDIKSEEPAIGQMETEWAENRAKIPQDSLRRLFDTVGLGGIYSTGERDKFIVRIEQGKNGVSDIFFAHKAMKEVYGGKDKDTTVWQPSPSDPNLEAAFLTRFMQYLGVDGQQAENASAKKPTLPAANEMARIEGKSLIVFGDYGRNWRRTALALDRIGLTVVGQNTERHAFLVQKAPNESNAVTEQKPGLFKRLLGKGKAEKPAEQPELIVYAEPVANGSRIVLLNKDGSAYAGKDASALLGKLHSELR

SEQ ID NO: 1525 - DNA, 300 bp, Neisseria gonorrhoeae
atgagtgcgagcgcggcaatgacgggtttgatatgggtcatcgtgtcatcctgtgtgatggatattaaagtgtttgtcatgttatgccgtccgaacggttcagacggcatggctatatttaaagttgtcctgaggctttcagggcggcgcggacttttgcctgtccgccttccgtcagcggaacgagcggcaggcgcacgtgcggtccgcatccgcccaaggcggataccgcccatttcggtgcggcgggactgggttcgcagaacatggtgtcgtaaatcggaatcagccggtcgttga

SEQ ID NO: 1526 - protein, 99 aa, Neisseria gonorrhoeae
MSASAAMTGLIWVIVSSCVMDIKVFVMLCRPNGSDGMAIFKVVLRLSGRRGLLPVRLPSAERAAGARAVRIRPRRIPPISVRRDWVRRTWCRKSESAGR

SEQ ID NO: 1527 - DNA, 300 bp, Neisseria meningitidis
wtgagtgcgagcgcggcaatgacgggtytgatatgggtcatcgtgtcatcstgtgtgatggatattaaagtgtytgttgcgwtatgccgtccgaacggttcggacggcatggmtatatttaaagttgtcctgaggctttcagggcggcgcggactkttgcwtgtccgtttyccgtcagcggaacgagcggcaggcggacgtgcggttcgcatctgcccagggcggataccgcccatttcggtgcggcggggctgggttcgcagaacatggtgtcgtaaatcggaatcagtcggtcgttga

SEQ ID NO: 1528 - protein, 99 aa, Neisseria meningitidis
  misc_feature (1)..(1): Xaa can be any naturally occurring amino acid
  misc_feature (25)..(25): Xaa can be any naturally occurring amino acid
  misc_feature (28)..(28): Xaa can be any naturally occurring amino acid
  misc_feature (38)..(38): Xaa can be any naturally occurring amino acid
  misc_feature (54)..(54): Xaa can be any naturally occurring amino acid
XSASAAMTGLIWVIVSSCVMDIKVXVAXCRPNGSDGMXIFKVVLRLSGRRGLLXVRFPSAERAAGGRAVRICPGRIPPISVRRGWVRRTWCRKSESVGR

SEQ ID NO: 1529 - DNA, 300 bp, Neisseria meningitidis
atgagtgcgagcgcggcaatgacgggtttgatatgggtcatcgtgtcatcctgtgtgatggatattaaagtgtttgttgcgttatgccgtccgaacggttcggacggcatggctatatttaaagttgtcctgaggctttcagggcggcgcggacttttgcctgtccgccttccgtcagcggaacgagcggcaggcggacgtgcggttcgcatctgcccagggcggataccgcccatttcggtgcggcggggctgggttcgcagaacatggtgtcgtaaatcggaatcagccggtcgttga

SEQ ID NO: 1530 - protein, 99 aa, Neisseria meningitidis
MSASAAMTGLIWVIVSSCVMDIKVFVALCRPNGSDGMAIFKVVLRLSGRRGLLPVRLPSAERAAGGRAVRICPGRIPPISVRRGWVRRTWCRKSESAGR

SEQ ID NO: 1531 - DNA, 489 bp, Neisseria gonorrhoeae
atgaccgccctactcgtcatcctcgccctcgccctgatagccgtcggcacggcaggcatcgtctatcccgccctgcccggcttggcattgatgtttgccggaacatggctgcttgcctatgccggcggctatcaaatctacggcgcaggcatcttgtggacggtcggactcatcagccttggcggcatactggcggactatatggcaggcatgttgggggtaaaatacactggggcaggcaaactcgccgtccgaggtgcattggccggcagcatcatcggcatatttttctcccttcccggactaatactcggcccctttatcggcgcggcggcaggcgaactgatcgatcggcgcaatatgcttcaggcaggtaaagcgggcttgggtacgctgttggggcttgtcgtcggcacggcgttcaaaatcggctgcgccgtatccatcttgtttatcctgttggtgaaatacatcgcatacctgttttaa

SEQ ID NO: 1532 - protein, 162 aa, Neisseria gonorrhoeae
MTALLVILALALIAVGTAGIVYPALPGLALMFAGTWLLAYAGGYQIYGAGILWTVGLISLGGILADYMAGMLGVKYTGAGKLAVRGALAGSIIGIFFSLPGLILGPFIGAAAGELIDRRNMLQAGKAGLGTLLGLVVGTAFKIGCAVSILFILLVKYIAYLF

SEQ ID NO: 1533 - DNA, 489 bp, Neisseria meningitidis
  misc_feature (438)..(438): n is a, c, g, or t
atgaccgtactgaccgtcatcctcgccctcgccctgatagccgtcggcacggcgggcatcgtttaccccgccctgcccggattggcattgatgtttgccggaacatggctgcttgcctatgccggcggctaccaaatctacggcgcgggcgttttgtggacggtcggactcatcagccttgccggcatactggcggactatgtggcaggcatatgggggacaaaatataccggagcgggcaagctcgccgttcgcggcgcattggccggcagcatcatcggcatatttttctcccttcccggactaatactcggtccctttatcggcgcggcggcaggcgaactgatcgaacggcgcaatatgcttcaggcaggtaaagcgggcttgggtacgctgttggggcttgtcgtcggcacggcgttcaaaatcggctgcgcngtatccatcttgtttatcctgttggtgaaatacatcgcctacctgttttaa

SEQ ID NO: 1534 - protein, 162 aa, Neisseria meningitidis
MTVLTVILALALIAVGTAGIVYPALPGLALMFAGTWLLAYAGGYQIYGAGVLWTVGLISLAGILADYVAGIWGTKYTGAGKLAVRGALAGSIIGIFFSLPGLILGPFIGAAAGELIERRNMLQAGKAGLGTLLGLVVGTAFKIGCAVSILFILLVKYIAYLF

SEQ ID NO: 1535 - DNA, 489 bp, Neisseria meningitidis
atgaccgccttgctcgtcatcctcgccctcgccctgatagccgccggtacggcgggcatcgtttaccccgccctgcccggattggcattgatgtttgccggaacctggctgctcgcctactccggcggctaccaaatctacggcgcgggcgttttgtggacggtcggactcatcagccttgccggcatactggcggactatgtggcaggcatatgggggacaaaatataccggagcgggcaagctcgccgttcgcggcgcattggccggcagcatcatcggcatatttttctcccttcccggactaatactcggtccctttatcggcgcggcggcaggcgaactgatcgaacggcgcaatatgcttcaggcaggtaaagcgggcttgggtacgctgttggggcttatcgtcggtacggcgttcaaaatcggctgcgccgtatccatcttgtttatcctgttggtgaaatacatcgcctacctgttttaa

SEQ ID NO: 1536 - protein, 162 aa, Neisseria meningitidis
MTALLVILALALIAAGTAGIVYPALPGLALMFAGTWLLAYSGGYQIYGAGVLWTVGLISLAGILADYVAGIWGTKYTGAGKLAVRGALAGSIIGIFFSLPGLILGPFIGAAAGELIERRNMLQAGKAGLGTLLGLIVGTAFKIGCAVSILFILLVKYIAYLF

SEQ ID NO: 1537 - DNA, 330 bp, Neisseria gonorrhoeae
atggctgaaacaatgaaaaaacaggcggattcgcctgatttggtgtacggtttggaagacaggccgccgttcggtaatgcgctcttgagcgcggttacccatcttttggcgattttcgtgccgatgattacgcccgcgctgattgtgggcggcgcgctggaattgccggtggagatgacggcgtatctggtgtcgatggcgatggttgcgtcgggtgtcggcacttatttgcaggtcaaccgcttcgggtcggtcggctcggggatgctgtccatccagcgttaccgtcatgattgcgctcggcgcggggatgaaagagggcggtttgag

SEQ ID NO: 1538 - protein, 110 aa, Neisseria gonorrhoeae
MAETMKKQADSPDLVYGLEDRPPFGNALLSAVTHLLAIFVPMITPALIVGGALELPVEMTAYLVSMAMVASGVGTYLQVNRFGSVGSGMLSIQRYRHDCARRGDERGRFE

SEQ ID NO: 1539 - DNA, 1392 bp, Neisseria meningitidis
atgagcggtcagttgggcaaaggtgcggatgcgcctgatttggtgtacggtttggaagacaggccgccgttcggtaatgcgctcttgagcgcggttacccatcttttggcgatttttgtgccgatgattacgcccgcgctgattgtgggcggcgcgctggaattgccggtggagatgacggcgtatctcgtgtcgatggcgatggttgcgtcgggtgtcggcacttatttgcaggtcaaccgcttcgggccggtcggttcggggatgctgtccatccagtcggtgaatttttcgttcgttaccgtgatgattgcgctgggcgcggggatgaaagagggcggtttgactaaggatgcgatgatttcgacgctcttgggcgtatcgtttgtcggcgcgtttttggtgtgtttctcggcgtggcttctgccgtatttgaaaaaagtgattacgccgacggtcagcggcgtggtcgtgatgctcattggtttgagtttggtacacgtcggcattaccgatttcggcggcggcttcggcgcgaaggcggacggcacgttcggctcgatggaaaacttggggctggcatcgctggtgttgctgattgtgttggtgttcaactgcatgaaaaacccgctgttgcgcatgagcggcattgcggtcgggctgattgccggctatatcgtcgcgctgtttttgggcaaggtggatttttccgcgctgcaaaacctgccgctggttacgctgcccgtaccgtttaaatacggttttgctttcgactggcacgcgtttattgtggcgggcgcgattttcttgttgagcgtgtttgaggcggtcggcgatttaaccgcgacggcaatggtgtccgaccagccgattgaaggcgaggaatacaccaaacgcctgcgcggcggcgtgttggctgacggcttggtgtcggtgattgcgacggctttgggttcgctgccgctgacgacgtttgcgcaaaacaacggcgtgattcagatgaccggcgtggcttcgcgccatgtgggcaaatatattgccgtgattttggtgctgttgggtctgttccccgttgtcggtcgcgcgtttacgacgattccgagtccggtgttgggcggcgcgatggttttgatgttcggcttaattgcgattgcgggcgtgcggattttggtcagtcacggcatccgcaggcgcgaagcggtgattgcggcaacgtcggtcggtttgggcttgggtgtcgcgtttgagccggaagtgtttaaaaacctgcccgtcttgttccaaaactctatttccgccggcggcattacggcagtcttgctgaatttggtcttgcccgaagataaaaccgaggcggcggtcaagtttgataccgaccacttggaacactga

SEQ ID NO: 1540 - protein, 463 aa, Neisseria meningitidis
MSGQLGKGADAPDLVYGLEDRPPFGNALLSAVTHLLAIFVPMITPALIVGGALELPVEMTAYLVSMAMVASGVGTYLQVNRFGPVGSGMLSIQSVNFSFVTVMIALGAGMKEGGLTKDAMISTLLGVSFVGAFLVCFSAWLLPYLKKVITPTVSGVVVMLIGLSLVHVGITDFGGGFGAKADGTFGSMENLGLASLVLLIVLVFNCMKNPLLRMSGIAVGLIAGYIVALFLGKVDFSALQNLPLVTLPVPFKYGFAFDWHAFIVAGAIFLLSVFEAVGDLTATAMVSDQPIEGEEYTKRLRGGVLADGLVSVIATALGSLPLTTFAQNNGVIQMTGVASRHVGKYIAVILVLLGLFPVVGRAFTTIPSPVLGGAMVLMFGLIAIAGVRILVSHGIRRREAVIAATSVGLGLGVAFEPEVFKNLPVLFQNSISAGGITAVLLNLVLPEDKTEAAVKFDTDHLEH

SEQ ID NO: 1541 - DNA, 1392 bp, Neisseria meningitidis
atgagcggtcagttgggcaaaggtgcggatgcgcctgatttggtgtacggtttggaggataggccgccgttcggtaatgcgctcttgagcgcggttacccatcttttggcgatttttgtgccgatgattacgcccgcgctgattgtgggcggcgcgctggaattgccggtggagatgacggcgtatctcgtgtcgatggcgatggttgcgtcgggtgtcggcacttatttgcaggtcaaccgcttcgggccggtcggttcggggatgctgtccatccagtcggtgaatttctcgttcgttaccgtcatgattgcgctcggcgcggggatgaaagagggcggtttgactaaggatgcgatgatttcgacgctcttgggcgtatcgtttgtcggcgcgtttttggtgtgtttttcggcgtggcttctgccgtatttgaaaaaagtgattacgccgacggtcagcggtgtggtggtgatgctgatcggcttgagtttggtacacgtcggtattaccgatttcggcggcggcttcggcgcaaaggcggacggcacgttcggctcgatggaaaacttggggctggcatcgctggtgctgctgattgtgctggtgttcaattgcatgaaaaacccgctgctgcggatgagcggcattgcggtcggtctgattgccggctatatcgtcgcgctgtttttgggcaaggtggatttttcggcactgcaaaacctgccgctggttacgctgcccgtaccgtttaaatatggttttgcttttgactggcacgcatttattgtggcgggtgcgattttcttgttgagcgtgtttgaggcggtcggcgatttgacggcgacggcaatggtgtccgaccagccgattgaaggcgaggaatacaccaaacgcttgcgcggcggcgtgttggcggacggcttggtgtcggtgattgcgacggctttgggttcgctgccgctgacgacgtttgcacaaaacaacggcgtgattcagatgaccggcgtggcttcgcgccatgtgggcaaatatattgccgtgattttggtgctgttgggtctgttccccgttgtcggacgcgcgtttacgacgattccgagtccggtgttgggcggcgcgatggttttgatgttcggcttgattgcgattgcgggcgtgcggattttggtcagccacggcatccgcaggcgcgaagcggtaattgcggcaacgtcggtcggtttgggcttgggtgtcgcgtttgagccggaagtgtttaaaaacctgcccgtcttgttccaaaactctatttccgccggcggcattacggcagtcttgctgaatttggtcttgcccgaagataaaaccgaggcggcggtcaagtttgataccgaccacttggaacactga

SEQ ID NO: 1542 - protein, 463 aa, Neisseria meningitidis; identical to SEQ ID NO: 1540

SEQ ID NO: 1543 - DNA, 789 bp, Neisseria gonorrhoeae
  misc_feature (25)..(25): n is a, c, g, or t
  misc_feature (35)..(35): n is a, c, g, or t
atgccctttcccgttttcagacaantatttgcttngtccttgctacggttttttgccgtaggtcggattctcgaatccgacatttccaacagcggtttttcggaaacgataaacgcgtcaaatgttttttttgtcggatacgaatatccggcctgcatttcaaatttacatcgcttccaatttcgcaaacttggtatccagttctttcacgccctgtttgccgaagttgatggtcagtcgggcggattcgcctttgtctgcggcatcgataatcacgccggtgccgaatttggcgtgacggacgttttgtccgatgcggaagcctgcgtaggtttgcggctgtttgaagtcatcgatgattttgtcccgttgtacggtggtttggcgcgtgttgccgtagctgtcgaaggcgggttttttgacggacaggtagtgcaatacttctggcgggatttcttcgacgaagcgggatgcgatgccgaattgggtttgtccgtgcagcatgcgttgctgtgccatggtgatgtagaggcgtttgcgggcgcgggtgatggcgacgtacatgaggcggcgttcttcttcgaggccgccgcgctcggcaaggctcatttcgctggggaaacgcccctcttccataccggtgaggaagacggcgttgaattccaagcctttggcggcgtggacggtcatcagttggacggctttttcgcctgcccctgcttggttttcgccggattcgagggcggcgttgctcaagaaggcgaggatggggaaggcgggatcgtctga

SEQ ID NO: 1544 - protein, 262 aa, Neisseria gonorrhoeae
  misc_feature (9)..(9): Xaa can be any naturally occurring amino acid
  misc_feature (12)..(12): Xaa can be any naturally occurring amino acid
MPFPVFRQXFAXSLLRFFAVGRILESDISNSGFSETINASNVFFVGYEYPACISNLHRFQFRKLGIQFFHALFAEVDGQSGGFAFVCGIDNHAGAEFGVTDVLSDAEACVGLRLFEVIDDFVPLYGGLARVAVAVEGGFFDGQVVQYFWRDFFDEAGCDAELGLSVQHALLCHGDVEAFAGAGDGDVHEAAFFFEAAALGKAHFAGETPLFHTGEEDGVEFQAFGGVDGHQLDGFFACPCLVFAGFEGGVAQEGEDGEGGIV

SEQ ID NO: 1545 - DNA, 786 bp, Neisseria meningitidis
atgccctttcccgttttcagacggccttttgctttgtccttacttacgttttttgccgtaagtcagattcttgtatccgacatttccaacagcggtgtttcggaaacaatagacgcgtcaaatgtttttgtcggatacgaatatccgacctacatttcaaatttacatctcttccaatttcgcaaacttggtgtccaactctttcacgccctgtttgccgaaattgatggtcagtcgggcggattcgcctttatctgcggcatcgataatcacgccggtgccgaatttggcgtggcggacgttttgtccgatacggaaacctgcgtaggtttggggctgtttgtagtcgtcgatgattttatctttggatgcggcggtttggcgcgtgttgccgtaactgtcgtaggcaggctttttgacggacaggtagtgcaatacttcgggtgggatctcttcgacgaagcgggagacgatgccgaattgggtttgtccgtgcagcatgcgttgttgcgccatggtgatgtagaggcgtttgcgggcgcgggtgatggcgacgtacatgaggcggcgttcttcttcgaggccgccgcgttcggcaaggctcatttcgctggggaagcggccttcttccatgccggtgaggaagacggcgttaaattccaagcctttggcggcgtggacggtcatgagttggacggccttttcgcctgcgcctgcctggttttcaccggattcgagggcggcattgcttaggaaggcgagaatggggaaggcggggtcgtctga

SEQ ID NO: 1546 - protein, 261 aa, Neisseria meningitidis
  misc_feature (251)..(251): Xaa can be any naturally occurring amino acid
MPFPVFRRPFALSLLTFFAVSQILVSDISNSGVSETIDASNVFVGYEYPTYISNLHLFQFRKLGVQLFHALFAEIDGQSGGFAFICGIDNHAGAEFGVADVLSDTETCVGLGLFVVVDDFIFGCGGLARVAVTVVGRLFDGQVVQYFGWDLFDEAGDDAELGLSVQHALLRHGDVEAFAGAGDGDVHEAAFFFEAAAFGKAHFAGEAAFFHAGEEDGVKFQAFGGVDGHELDGLFACACLVFTGFEGGIAXEGENGEGGVV

SEQ ID NO: 1547 - DNA, 771 bp, Neisseria meningitidis
ttcagacggccttttgccttgtccttgctacagttttttgccataggtcggattctcgaatccgacatttccaacagcggtttttcggaaacgatagacgcgtcaaatatttttgtcggatacgagtatccagcctgcatttcaaatttacatcgcttccaatttcgcaaacttggtgtccaactctttcacgccctgtttgccgaaattgatggtcagtcgggcggattcgcctttatctgcggcatcgataatcacgccggtgccgaatttggcgtggcggacgttttgtccgatacggaaacctgcgtaggtttggggctgtttgtagtcgtcgatgattttgtctttgggcgcggcggtttggcgcgtgttgccatagcggtcgtaggcgggttttttgacggacaggtagtgcaatacttcgggcgggatttcttcgacgaagcgggagacgatgccgaattgggtttgtccgtgcagcatgcgttgttgcgccatggtgatgtagaggcgtttgcgggcgcgggtgatggcgacgtacatcaggcggcgttcttcttcgaggccgccgcgttcggcaaggctcatttcgctggggaagcggccttcttccatgccggtgaggaatacggcgttaaattccaagcctttggcggcgtgcacggtcatgagttgtacggctttttcgcccgcgcctgcttggttttcgccggattcgagagcagcattgcttaggaaagcgaggatggggaaggcggggtcgtctga

SEQ ID NO: 1548 - protein, 255 aa, Neisseria meningitidis
FRRPFALSLLQFFAIGRILESDISNSGFSETIDASNIFVGYEYPACISNLHRFQFRKLGVQLFHALFAEIDGQSGGFAFICGIDNHAGAEFGVADVLSDTETCVGLGLFVVVDDFVFGRGGLARVAIAVVGGFFDGQVVQYFGRDFFDEAGDDAELGLSVQHALLRHGDVEAFAGAGDGDVHQAAFFFEAAAFGKAHFAGEAAFFHAGEEYGVKFQAFGGVHGHELYGFFARACLVFAGFESSIAESEDGEGGVV

SEQ ID NO: 1549 - DNA, 1281 bp, Neisseria gonorrhoeae
atgaaatccctttttatttggctgcttctattgggctcggcggcaggcgttttctaccatacccaaaaccaatccctgcccgcgggcgaacttgtctatccgtccgcaccgcaaatcagggacggcggcgatgcgctgcactacctcaaccgcatccgcacacaaatcggtttgcacgcgctggcacacgcgccggttttggaaaattccgcccgcaggcacgcacgctatctcacgctcaatcccgaagacggacacggcgaacaccatcccgacaatccgcactacaccgcacaaaagctgaccgaacgcacacgccttgccgggtatctctacaacggcgtgcatgaaaacatcagcacggaagaggaagccgccgaatcgtccgacagcgacatccgcacgcagcaacgccaagtggacgctttgatgagcgcaatctaccaccgcctttcgctgcttgaccgccataccgacgaagcaggtgcggcatttgtgcgcgaaaacggcaaaaccgtcctcgtattcaatcagggcaacggcagcttcgagcgcgcctgtgcaaaaggaaggcggcagccggaagcaggacggaaatattaccgcaacgcttgccacaacggtgcggccgtttatgctgacgaagccatgcccgtaacggaattgctttataccgcctatccggttggcggcggcgcgctgccttatttttacggggaacgtcccgaccccgtgccggaatatgaaatcacaggcaatcctgccagcattgatttttccgaggcggcaggcaaaattgcgatgaaaagtttcaagctgtatcagggtaaaaacgaaatccgccccgtcagggttttaaccgccggcaacgaccctaacggcaggctgaccgcgcaccaattcgcccttttcccgctcaaacctttggaatacggcacgctttatacggcggtattcgactatgtccgcaacggacggcacgcgcaggcgaaatggcagtttagaacccgaaaacccgattacccttattttgaggtaaacggcggcgagacacttgcggttagaaaaggcgaaaaatatttcatccactggcgcggacgctggtgtctggaagcgtgtacccgttatacctaccggcggcagttcggcaacagcctgtccatactccggcacgaagcgggcggcattgtcttcagcgtcagcggaatggcgggaagccgcatcaggcttactccggaagacagcccggaacgcggtgtaaccctttatttgcaggattga

SEQ ID NO: 1550 - protein, 426 aa, Neisseria gonorrhoeae
MKSLFIWLLLLGSAAGVFYHTQNQSLPAGELVYPSAPQIRDGGDALHYLNRIRTQIGLHALAHAPVLENSARRHARYLTLNPEDGHGEHHPDNPHYTAQKLTERTRLAGYLYNGVHENISTEEEAAESSDSDIRTQQRQVDALMSAIYHRLSLLDRHTDEAGAAFVRENGKTVLVFNQGNGSFERACAKGRRQPEAGRKYYRNACHNGAAVYADEAMPVTELLYTAYPVGGGALPYFYGERPDPVPEYEITGNPASIDFSEAAGKIAMKSFKLYQGKNEIRPVRVLTAGNDPNGRLTAHQFALFPLKPLEYGTLYTAVFDYVRNGRHAQAKWQFRTRKPDYPYFEVNGGETLAVRKGEKYFIHWRGRWCLEACTRYTYRRQFGNSLSILRHEAGGIVFSVSGMAGSRIRLTPEDSPERGVTLYLQD

SEQ ID NO: 1551 - DNA, 494 bp, Neisseria meningitidis
atgaaatccctttttattcggctgctcctgttgggttcggcggcaggcgttttctaccatacccaaamccaatccctgcccgcgggcgaacttgtctatccgtccgcaccgcaaatcagggacggcggcgatgcgctgcactacctcaaccgcatccgagcccaaatcggtttgcacaagctggcacacgcgccggttttggaaaactccgcccgcaggcacgcaagctacctcacgctcaatcccgaagacggacacggcgaacaccatcccgacaatccgcactacaccgcacaaaagctgaccgaacgcacacgccttgccgggtatctctacaacggcgtgcatgaaaacatcagcacggaagaagaagccgccgaatcgtccgacagcgacatccgcacgcagcaacgccaagtggacggattaatgagcgcaatctaccaccgcctttccctacttgaccgccatacggatgagtcaggagcggcatt

SEQ ID NO: 1552 - protein, 164 aa, Neisseria meningitidis
  misc_feature (23)..(23): Xaa can be any naturally occurring amino acid
MKSLFIRLLLLGSAAGVFYHTQXQSLPAGELVYPSAPQIRDGGDALHYLNRIRAQIGLHKLAHAPVLENSARRHASYLTLNPEDGHGEHHPDNPHYTAQKLTERTRLAGYLYNGVHENISTEEEAAESSDSDIRTQQRQVDGLMSAIYHRLSLLDRHTDESGAA

SEQ ID NO: 1553 - DNA, 1281 bp, Neisseria meningitidis
atgaaatccctttttattcggctgctcctgttgggttcggcggccggcgttttctatcatacccaaaaccaatccctgcccgcgggcgaacttgtctatccgtccgcaccgcaaatcagggacggcggcgatgcgctgcactacctcaaccgcatccgcgcccaaatcggtttgcacaagctggcacacgcgccggttttggaaaattccgcccgcaggcacgcacgctatctcacgctcaatcccgaagacggacacggcgaacaccatcccgacaatccgcactacaccgcacaaaagctgaccgaacgcacacgccttgccgggtatctctacaacggcgtgcatgaaaacatcagcacggaagaggaagccgccgaatcgtccgacagcgacatccgcacgcagcaacgccaagtggacggattaatgagcgcaatctaccaccgcctttccctacttgaccgccatacggatgaggcaggagcggcatttgtgcgcgaaaacggtaaaaccgttctcgtattcaatcagggcaacggcaggtttgagcggcattgcgcccaaggcagaaatcagccggaagcaggacggaaatattaccgcaacgcctgccataacggtgcggtcgtgtacaccgacgaagccatgcccgcacaggagctgctctatacagcctatcccgtcggcaacggcgcactgccttatttccacggcgagcgtccagaccccgtgccggaatatgaaatcacgggcaatcctgccagcattgatttttccgaggcggcaggcaaaattacgatgaaaagtttcaagctgtatcagggtaaaaacgaaatccgccccgtcagggttttaaccgccggcaacgaccccaacggcaggctgaccgcgtaccaattcgcgcttttcccgctcaagcctttggaatacggtacgctttatacggcggtattcgactatgtccgcaacggacggcgcgcgcaggcgaaatggcagtttagaacccgaaaacccgattacccttattttgaggtaaacggcggcgagacacttgcggttagaaaaggcgaaaaatatttcatccactggcgcggacgctggtgtttggaagcgtgtacccgttatacctaccggcagcgacccggcagccgcctgtccataggaaggcacaaggcgggcggcatcgtcttcagcgttgacggaatggcgggcagccgcatcacgcttgcaccggaaggagaaacggaacgaggcgtaaccctttatttacaggattga

SEQ ID NO: 1554 - protein, 426 aa, Neisseria meningitidis
MKSLFIRLLLLGSAAGVFYHTQNQSLPAGELVYPSAPQIRDGGDALHYLNRIRAQIGLHKLAHAPVLENSARRHARYLTLNPEDGHGEHHPDNPHYTAQKLTERTRLAGYLYNGVHENISTEEEAAESSDSDIRTQQRQVDGLMSAIYHRLSLLDRHTDEAGAAFVRENGKTVLVFNQGNGRFERHCAQGRNQPEAGRKYYRNACHNGAVVYTDEAMPAQELLYTAYPVGNGALPYFHGERPDPVPEYEITGNPASIDFSEAAGKITMKSFKLYQGKNEIRPVRVLTAGNDPNGRLTAYQFALFPLKPLEYGTLYTAVFDYVRNGRRAQAKWQFRTRKPDYPYFEVNGGETLAVRKGEKYFIHWRGRWCLEACTRYTYRQRPGSRLSIGRHKAGGIVFSVDGMAGSRITLAPEGETERGVTLYLQD

SEQ ID NO: 1555 - DNA, 1100 bp, Neisseria gonorrhoeae
atgtcaggtagaacaggacggaacagtgccactcaggcgcaaccggaacgcgtcatgctggtgggcgtaatgttggataaagatgatacgggcagcaatgccgcccgtctgaacggttttcagacggcattggcggaagccgtcgagctggtcaaagcggcgggcggcgattccgtacgcgtggagactgccaaacgcgaccgcccgcacactgcgctgtttgtcggcacgggcaaggcggcggagctgtcggaagcagttgccgcagacggcattgatttggtcgtattcaaccacgaacttactcccacgcaggaacgcaatttggaaaaaatcctccaatgccgcgtattggacagagtggggctgattctggcgattttcgcccgccgcgcccgcacgcaggaaggcaggctgcaagtcgagttggcgcaattgagccatttggcgggacgcttgatacgcggttacggacatttgcaaagccagcgcggcggtatcggcatgaaagggccgggcgaaaccaaactggaaaccgaccgccgattaaccgcccatcggatcaacgccttgaaaaaacagcttgccaacctcaaaaaacagcgcgccctgcgccgcaagtcccgcgagtcgggcagaatcaaaacgtttgcgctggtcggctataccaatgtcggcaaatccagcctgttcaaccggctgaccaagtcgggcatatatgcgaaagaccagcttttcgccactctcgacacgacggcgcggcggctgtacatcagtcccgcatgcagcattatcctgaccgataccgtcggattcgtcagcgatctgccgcacaaactgatttccgccttttccgccaccttggaagaaaccgtgcaagccgatgtgctgctgcacgtcgtcgatgctgccgcccggaacagcgggcagcagattgaagacgtggaaaacgtactgcaagaaatccatgcccacgatattccgtgcatcaaggtgtacaacaaaaccgacctgctgccgtctgaagaacaaaacacgggcatatggcgcgacgctgcgggaaaaattgccgccgtccgcatttccgttgctgaaaatac

SEQ ID NO: 1556 - protein, 392 aa, Neisseria gonorrhoeae
MSGRTGRNSATQAQPERVMLVGVMLDKDDTGSNAARLNGFQTALAEAVELVKAAGGDSVRVETAKRDRPHTALFVGTGKAAELSEAVAADGIDLVVFNHELTPTQERNLEKILQCRVLDRVGLILAIFARRARTQEGRLQVELAQLSHLAGRLIRGYGHLQSQRGGIGMKGPGETKLETDRRLTAHRINALKKQLANLKKQRALRRKSRESGRIKTFALVGYTNVGKSSLFNRLTKSGIYAKDQLFATLDTTARRLYISPACSIILTDTVGFVSDLPHKLISAFSATLEETVQADVLLHVVDAAARNSGQQIEDVENVLQEIHAHDIPCIKVYNKTDLLPSEEQNTGIWRDAAGKIAAVRISVAENTGIDALREAIAEYCAAAPNTDETEMP

SEQ ID NO: 1557 - DNA, 1139 bp, Neisseria meningitidis
  misc_feature (624)..(624): n is a, c, g, or t
  misc_feature (780)..(780): n is a, c, g, or t
atgacaggcagaacaggcggcaacggcagtacccaagcgcaacccgaacgcgtcatgctggtgggcgtaatgttggacaaagatggtacgggcagtagtgccgcccgtctgaacggttttcagacggcattggcggaagctgtcgagctggtcaaagcggcgggcggcgattccgtgcgcgtggagactgccaaacgcgaccgtccgcacaccgcgctgtttgtcggcacgggcaaggcggcggagctgtcagaagcagttgccgcagacggcatcgatttggtcgtattcaaccacgaactcacgcccacgcaggaacgcaaccttgaaaaagaactsaaatgccgcgtattggacagggtagggctgattctggcgattttcgctcgccgcgcccgcacgcaggaaggcaggctgcaagtcgagttggcgcaattgagccatttggcgggacgcttgatacgcggttacggccatctgcagagccagcgcggcggtatcggcatgaaaggccccggcgaaaccaaactggaaaccgaccgccgattgatcgcccatcggatcaatgccttgataaaacagcttgccaacctcaaaaaacagcgcgccctgcgccgcaagtcncgcgaatcgggcacaatcaaaacgtttgcgctggtcggctatacaaatgtcggaaaatccagcctgttcaaccggctgacaaagtcgggcatatatgcaaaggacaagcttagtcccgaatgcagcattatcctgaccgataccgtcggattcgtnagcgatctgccgcacaaactgatttccgccttttcgccacgctggaagaaaccgcgcaagccgatgtgctgctgcacgtcgtcgatgccgccgctccgaacagcggacagcagattgaagacgtggaaaacgtactgcaagaaatccatgccggcgatattccgtgcatcaaggtgtacaacaaaaccgacctgctgccgtctgaagaacaaaacacgggcatatggcgcgacgctgcgggaaaaattgccgccgtccgcatttccgttgctgaaaataccggtatagacgcactgcgcgaagccattgccgagtcttgtgccgccgcaccaaacacagacgaaaccgaaatgccatga

SEQ ID NO: 1558 - protein, 379 aa, Neisseria meningitidis
  misc_feature (273)..(273): Xaa can be any naturally occurring amino acid
MTGRTGGNGSTQAQPERVMLVGVMLDKDGTGSSAARLNGFQTALAEAVELVKAAGGDSVRVETAKRDRPHTALFVGTGKAAELSEAVAADGIDLVVFNHELTPTQERNLEKELKCRVLDRVGLILAIFARRARTQEGRLQVELAQLSHLAGRLIRGYGHLQSQRGGIGMKGPGETKLETDRRLIAHRINALIKQLANLKKQRALRRKSRESGTIKTFALVGYTNVGKSSLFNRLTKSGIYAKDKLSPECSIILTDTVGFVSDLPHKLISAFSXTLEETAQADVLLHVVDAAAPNSGQQIEDVENVLQEIHAGDIPCIKVYNKTDLLPSEEQNTGIWRDAAGKIAAVRISVAENTGIDALREAIAESCAAAPNTDETEMP

SEQ ID NO: 1559 - DNA, 1179 bp, Neisseria meningitidis
atgacaggcagaacaggccgcaacggcagtacccaagcgcaacccgaacgcgtcatgctggtgggcgtaatgttggacaaagatggtacgggcagcagtgccacccgtctgaacggttttcagacggcattggcggaagctgtcgagctggtcaaagcggcgggcggcgattccgtgcgcgtggagactgccaaacgcgaccgtccgcacaccgcgctgtttgtcggcacgggcaaggcggcggagctgtcggaagcagttgccgcagacggcatcgatttggtcgtattcaaccacgaacttacgcccacgcaggaacgcaatttggaaaaaatcctccaatgccgcgtattggacagagtggggctgattctggcgattttcgcccgccgcgcccgcacgcaggaaggcaggctgcaagtcgagttggcacaattgagccatttggcgggacgcttgatacgcggttacggccatctgcagagccagcgcggcggtatcggcatgaaaggccccggcgaaaccaaactggaaaccgaccgccgattgatcgcccatcggatcaatgccttgaaaaaacagcttgccaacctcaaaaaacagcgcgccctgcgccgcaagtcccgcgaatcgggcacaatcaaaacgtttgcgctggtcggctataccaatgtcggcaaatccagtctgttcaaccggctgaccaagtcgggcatatatgcgaaagaccagcttttcgccacactcgacacgacggcgcggcggctgtacatcagtcccgaatgcagcattatcctgaccgataccgtcggattcgtcagcgatctgccgcacaaactgatttccgccttttccgccacgctggaagaaaccgcgcaagccgatgtgctgctgcacgtcgtcgatgccgccgctccgaacagcggacagcagattgaagacgtggaaaacgtactgcaagaaatccatgccggcgatattccgtgcatcaaggtgtacaacaaaaccgacctgctgccgtctgaagaacaaaacacgggcatatggcgcgacgctgcgggaaaaattgccgccgtccgcatttccgttgctgaaaataccggtatagacgcactgcgcgaagccattgccgagtattgtgccgccgcaccaaacacagacgaaaccgaaatgccatga

SEQ ID NO: 1560 - protein, 392 aa, Neisseria meningitidis
MTGRTGRNGSTQAQPERVMLVGVMLDKDGTGSSATRLNGFQTALAEAVELVKAAGGDSVRVETAKRDRPHTALFVGTGKAAELSEAVAADGIDLVVFNHELTPTQERNLEKILQCRVLDRVGLILAIFARRARTQEGRLQVELAQLSHLAGRLIRGYGHLQSQRGGIGMKGPGETKLETDRRLIAHRINALKKQLANLKKQRALRRKSRESGTIKTFALVGYTNVGKSSLFNRLTKSGIYAKDQLFATLDTTARRLYISPECSIILTDTVGFVSDLPHKLISAFSATLEETAQADVLLHVVDAAAPNSGQQIEDVENVLQEIHAGDIPCIKVYNKTDLLPSEEQNTGIWRDAAGKIAAVRISVAENTGIDALREAIAEYCAAAPNTDETEMP

SEQ ID NO: 1561 - DNA, 1149 bp, Neisseria gonorrhoeae
atggaggatctgcaggaaatcgggttcgatgtcgccgccgtaaaggtaggtcggcagcgcgaacatcatcgtctgcatcatacccagtccggcaacggcaaggcggacgatgtattgtttgcgttctttttggttggcggcttcgattttttgcgcgtcatagggtgcggcggtgtagcctgtctgccggattttcaacagaatgtcggagaggcggattttgccgtcgtcccagacgacgcggcagcggtgcgtgctgtaattgaggtcgatgcggacgatgccgtctgtgcgcaaaagctgctgttcgatcagccagacgcaggcggcgcaggtaatgccgctgagcatcagcactgcttcgtgcgtgccattatgggtttccacaaagtcggattggacttcgggcaggtcgtacaggcggatttggtcgaggatttcttggggcggcagttcggtttttttcgcgtcggcggtgcgtcgtttgtaataactgcccaagccggaatcgatgatgctttgtgcgactgcctgacagccgacgcagcaggtttcgcggtcttcgccttcgtagcggacggtcagatgcaggttttcgggaacgtccagcccgcagtggaaacaggtttttttcatggcatttcggtttcgtctgtgtttggtgcggcggcacaatactcggcaatggcttcgcgcagtgcgtctataccggtattttcagcaacggaaatgcggacggcggcaatttttcccgcagcgtcgcgccatatgcccgtgttttgttcttcagacggcagcaggtcggttttgttgtacaccttgatgcacggaatatcgtgggcatggatttcttgcagtacgttttccacgtcttcaatctgctgcccgctgttccgggcggcagcatcgacgacgtgcagcagcacatcggcttgcacggtttcttccaaggtggcggaaaaggcggaaatcagtttgtgcggcagatcgctgacgaatccgacggtatcggtcaggataatgctgcatgcgggactgatgtacagccgccgcgccgtcgtgtcgagagtggcgaaaagctggtctttcgcatatatgcccgacttggtcagccggttgaacaggctggatttgccgacattggtatag

SEQ ID NO: 1562 - protein, 382 aa, Neisseria gonorrhoeae
MEDLQEIGFDVAAVKVGRQREHHRLHHTQSGNGKADDVLFAFFLVGGFDFLRVIGCGGVACLPDFQQNVGEADFAVVPDDAAAVRAVIEVDADDAVCAQKLLFDQPDAGGAGNAAEHQHCFVRAIMGFHKVGLDFGQVVQADLVEDFLGRQFGFFRVGGASFVITAQAGIDDALCDCLTADAAGFAVFAFVADGQMQVFGNVQPAVETGFFHGISVSSVFGAAAQYSAMASRSASIPVFSATEMRTAAIFPAASRHMPVFCSSDGSRSVLLYTLMHGISWAWISCSTFSTSSICCPLFRAAASTTCSSTSACTVSSKVAEKAEISLCGRSLTNPTVSVRIMLHAGLMYSRRAVVSRVAKSWSFAYMPDLVSRLNRLDLPTLV

SEQ ID NO: 1563 - DNA, 1035 bp, Neisseria meningitidis
  misc_feature (992)..(992): n is a, c, g, or t
atggaggatttgcaggaaatcgggttcgatgtcgccgccgtaaaggtaggtcggcagcgcgaacatcatcgtctgcatcatccccagcccggcaacggcgaggcggacgatgtattgtttgcgttctttttggttggcggcttcgattttttgcgcgtcatagggtgcggcggtgtagcctatctgcctgattttcaacagaatgtcggaaaggcggattttgccgtcgtcccagacgacgcggcagcggtgcgtgctgtaattgaggtcgatgcggacgatgccgtctgtacgcaaaagctgctgttcgatcagccagacgcaggcggcgcaggtgatgccgccgagcattaaaaccgcctcgcgcgtgccgccgtgggtttccacaaagtcggactggacttcgggcaggtcgtacaggcggatttggtcgaggatttcttggggcggcagctcggttttttgcgcgtcggcggtgcgttgtttgtaataactgcccaagcccgcgtcaataatgctttgtgcgaccgcctgacagccggcgcacagggtttcgcggtcttcgttttcgtaacggacagtcaggtggaggtgttcgggaacatccagaccgcagtggaaacaggtttttttcatggcatttcggtttcgtctgtgtttggtgcggcggcacaagactcggcaatggcttcgcgcagtgcgtctataccggtattttcagcaacggaaatgcggacggcggcaatttttcccgcagcgtcgcgccatatgcccgtgttttgttcttcagacggcagcaggtcggttttgttgtacaccttgatgcacggaatatcgccggcatggatttcttgcagtacgttttccacgtcttcaatctgctgtccgctgttcggagcggcggcatcgacgacgtgcagcagcacatcggcttgcgcggtttcttccagcgtggcgaaaaggcggaaatcagtttgtgcggcagatcgctnacgaatccgacggtatcggtcaggataatgctgcattcgggac

SEQ ID NO: 1564 - protein, 344 aa, Neisseria meningitidis
  misc_feature (319)..(319): Xaa can be any naturally occurring amino acid
MEDLQEIGFDVAAVKVGRQREHHRLHHPQPGNGEADDVLFAFFLVGGFDFLRVIGCGGVAYLPDFQQNVGKADFAVVPDDAAAVRAVIEVDADDAVCTQKLLFDQPDAGGAGDAAEHNRLARAAVGFHKVGLDFGQVVQADLVEDFLGRQLGFLRVGGALFVITAQARVNNALCDRLTAGAQGFAVFVFVTDSQVEVFGNIQTAVETGFFHGISVSSVFGAAAQDSAMASRSASIPVFSATEMRTAAIFPAASRHMPVFCSSDGSRSVLLYTLMHGISPAWISCSTFSTSSICCPLFGAAASTTCSSTSACAVSSSVAXKAEISLCGRSLTNPTVSVRIMLHSG

SEQ ID NO: 1565 - DNA, 1149 bp, Neisseria meningitidis
atggaggatttgcaggaaatcgggttcgatgtcgccgccgtaaaggtaggtcggcagcgcgaacatcatcgtctgcatcatccccagcccggcaacggcgaggcggacgatgtattgtttgcgttctttttggttggcggcttcgattttttgcgcgtcatagggtgcggcggtgtagcctatctgcctgattttcaacagaatgtcggaaaggcggattttgccgtcgtcccagacgacgcggcagcggtgcgtgctgtaattgaggtcgatgcggacgatgccgtctgtacgcaaaagctgctgttcgatcagccagacgcaggcggcgcaggtgatgccgccgagcattaaaaccgcctcgcgcgtgccgccgtgggtttccacaaagtcggactggacttcgggcaggtcgtacaggcggatttggtcgaggatttcttggggcggcagctcggttttttgcgcgtcggcggtgcgttgtttgtaataactgcccaagcccgcgtcaataatgctttgtgcgactgcctgacaaccggcgcagcaggtttcgcggtcttcgttttcgtaacggacggtcagatgcaggttttcgggaacgtccagcccgcagtggaaacaggtttttttcatggcatttcggtttcgtctgtgtttggtgcggcggcacaatactcggcaatggcttcgcgcagtgcgtctataccggtattttcagcaacggaaatgcggacggcggcaatttttcccgcagcgtcgcgccatatgcccgtgttttgttcttcagacggcagcaggtcggttttgttgtacaccttgatgcacggaatatcgccggcatggatttcttgcagtacgttttccacgtcttcaatctgctgtccgctgttcggagcggcggcatcgacgacgtgcagcagcacatcggcttgcgcggtttcttccagcgtggcggaaaaggcggaaatcagtttgtgcggcagatcgctgacgaatccgacggtatcggtcaggataatgctgcattcgggactgatgtacagccgccgcgccgtcgtgtcgagtgtggcgaaaagctggtctttcgcatatatgcccgacttggtcagccggttgaacagactggatttgccgacattggtatag

SEQ ID NO: 1566 - protein, 381 aa, Neisseria meningitidis
MEDLQEIGFDVAAVKVGRQREHHRLHHPQPGNGEADDVLFAFFLVGGFDFLRVIGCGGVAYLPDFQQNVGKADFAVVPDDAAAVRAVIEVDADDAVCTQKLLFDQPDAGGAGDAAEHNRLARAAVGFHKVGLDFGQVVQADLVEDFLGRQLGFLRVGGALFVITAQARVNNALCDCLTTGAAGFAVFVFVTDGQMQVFGNVQPAVETGFFHGISVSSVFGAAAQYSAMASRSASIPVFSATEMRTAAIFPAASRHMPVFCSSDGSRSVLLYTLMHGISPAWISCSTFSTSSICCPLFGAAASTTCSSTSACAVSSSVAEKAEISLCGRSLTNPTVSVRIMLHSGLMYSRRAVVSSVAKSWSFAYMPDLVSRLNRLDLPTLV

SEQ ID NO: 1567 - DNA, 447 bp, Neisseria gonorrhoeae
atgccgccctcccgacgcggcaacggggtgttttatcaaaacggcaaacttgccaatgcggtttccgcttgccgattgccaaaccggcaaacctttcccgtgccggtgccgaacccgatgccgtctgaaccttcagacggcatcgggtgtttatttgtccactcggacgggtgcaggttcgtattgtgtcgattcgtcgccgtaatacagcacgccgagtttgacggggatgcgtccctgcgatttgcggtgggcgttggaatcgcgcaaggaatacgcgcagccgcagtattcctgctggtagaagttttcgcgtttgctgatttcaatcatacgcgcgccgccgccgcctttgcgccagttgaagtcccaataggccacatcatcgtaaggcgcggcggcacggtgtccgcagtcgttgatttgcgccatatttttccagcgtga

SEQ ID NO: 1568 - protein, 148 aa, Neisseria gonorrhoeae
MPPSRRGNGVFYQNGKLANAVSACRLPNRQTFPVPVPNPMPSEPSDGIGCLFVHSDGCRFVLCRFVAVIQHAEFDGDASLRFAVGVGIAQGIRAAAVFLLVEVFAFADFNHTRAAAAFAPVEVPIGHIIVRRGGTVSAVVDLRHIFPA

SEQ ID NO: 1569 - DNA, 339 bp, Neisseria meningitidis
ccgaacccgatgccgtctgaaccttcagacggcatcgggtgtttatttgtccacccggatgggggcaggttcgtattgtgtcgattcgtcgccgtaatacagcacgccgagtttgatggggattctgccctgtgatttgcggtgggcattggaatccctcagggaataggcacaaccgcaatattcctgctggtagaagttttcacgtttgctgatttcaatcatgcgcgcgctgccgccgcctttgcgccagttgaaatcccaatacaccacatcatcgtaaggcgcggcggcgcggtgtccgcagtcgttgatttgcgccatatttttccagcgtga

SEQ ID NO: 1570 - protein, 111 aa, Neisseria meningitidis
PNPMPSEPSDGIGCLFVHPDGGRFVLCRFVAVIQHAEFDGDSALFAVGIGIPQGIGTTAIFLLVEVFTFADFNHARAAAAFAPVEIPIHHIIVRRGGAVSAVVDLRHIFPA

SEQ ID NO: 1571 - DNA, 441 bp, Neisseria meningitidis
atgccgtcctcccgacgcggcaacggggtgttttatcaaaacggcaaacttgccaatgcggtttccgattgcagattgccaaaccggcaaacctttcccgtgccgatgccgaacccgatgccgtctgaaccttcagacggcatcgggtgtttatttgtccacccggatgggtgcaggttcgtattgtgtcgattcgtcgccgtaatacagcacgccgagtttgatggggattctgccctgtgatttgcggtgggcgttggaatccctcagggaataggcacaaccgcaatattcctgctggtagaagttttcacgtttgctgatttcaatcatacgcgcgctgccgccgcctttgcgccagttgaaatcccaatacaccacatcatcgtaaggcgcggcggcgcggcggccgcagtcgttaatctggttcatgtttttcca

SEQ ID NO: 1572 - protein, 145 aa, Neisseria meningitidis
MPSSRRGNGVFYQNGKLANAVSDCRLPNRQTFPVPMPNPMPSEPSDGIGCLFVHPDGCRFVLCRFVAVIQHAEFDGDSALFAVGVGIPQGIGTTAIFLLVEFTFADFNHTRAAAAFAPVEIPIHHIIVRRGGAAAAVVNLVHVFP

SEQ ID NO: 1573 - DNA, 336 bp, Neisseria gonorrhoeae
atgccgaaatggtcgcgcatacggcgttgcagcgtcctttcgctgatgttcagcgcggctgtcagccggttgacttggtgtgcgccgccgtcgaacgcggcattcagggtgcggctgaagtcttcagacggcatagcgtctgcttccgccgtttgccccgccgccggctcgatgccgtctgaaaccgtgtcccacaaatccgacagcagccgcaacacgtccgcctcgcggcgcaatgtttcgcccaaatgcccctttgggacggtttgcaggcaggatgccgccaagccgcgcaggtttgggggcaaatcccatatcctgaccggttcgcggtaa

SEQ ID NO: 1574 - protein, 111 aa, Neisseria gonorrhoeae
MPKWSRIRRCSVLSLMFSAAVSRLTWCAPPSNAAFRVRLKSSDGIASASAVCPAAGSMPSETVSHKSDSSRNTSASRRNVSPKCPFGTVCRQDAAKPRRFGGKSHILTGSR

SEQ ID NO: 1575 - DNA, 335 bp, Neisseria meningitidis
atgccgaaatggtcgcgcatacggcgttgcagcgtcctttcactgatgttcagcgcgtctgtcagccggttgacttggtgtgcgccgtcggcaaacgcggcatttagggtgcggctgaagtcttcagacggcatagcgtctgcttccgccgtttgccccgccgccggcccgatgccgtctgaaaccgtgtcccacaagtccgacagcagccgcaacacgtccgcctcgcgcgcaatgtttcgcccaaatgcccctttgggacggctttcaggcaggatgccgccaagccgcgcaggttcgggggcaaatcccatatcctgaccggttcgcggtaa

SEQ ID NO: 1576 - protein, 121 aa, Neisseria meningitidis
MPKWSRIRRCSVLSLMFSASVSRLTWCAPSANAAFRVRLKSSDGIASASAVCPAAGPMPSETVSHKSDSSRNTSASRAMFRPNAPLGRNVSPKCPFGTAFRQDAAKPRRFGGKSHILTGSR

SEQ ID NO: 1577 - DNA, 336 bp, Neisseria meningitidis
atgccgaaatggtcgcgcatacggcgttgcagcgtcctttcgctgatgttcagcgtgtctgccagccggttgacttgatgtgcgccgccggcaaacgcggcattcaggatgcggctgaagtcttcagacggcatagcgtctgcttccgccgtttgccccgccgccggcccgatgccgtctgaaaccgtgtcccacaagtccgacagcagccgcaacacgtccgcctcgcggcgcaatgtttcgcccaaatgcccctttgggacggctttcaggcaggatgccgccaagccgcgcaggttcgggggcaaatcccatatcctgaccggttcgcggtaa

SEQ ID NO: 1578 - protein, 110 aa, Neisseria meningitidis
MPKWSRIRRCSVLSLMFSVSASRLTCAPPANAAFRMRLKSSDGIASASAVCPAAGPMPSETVSHKSDSSRNTSASRRNVSPKCPFGTAFRQDAAKPRRFGGKSHILTGSR

SEQ ID NO: 1579 - DNA, 1131 bp, Neisseria gonorrhoeae
atggtttgtcggttatttgccgccgtttttggctttcaactcggcaatcagcccgtcgatgcctttggctttgatgatttcgccgaattggttgcggtacacggtaaccaggctcgtgccttcgatggcgacgttgtaggtacggtatttgccgccgctttggtaggtggtaaagtccatattgacgggcttctgaccggggatgccgacttcggcacggacgacgatttccttgccgcccttattgacgatgggattgtctttgacgttgacggtcgcgtttttgaatttcagcatcgtgccggaataggtgcggatcagcagggtttgaaattctttggccaacgcttgtttttgcgcgtcggacgcggtacgccaagggttgccgaccgccaatgcggtcatacgttggaaatcgaaatagggaaccgcataggcttcggcttttgggcgtgcagaagccgcgtcgccgcttttgaggatggtcaaaacctgtgtggcgttttggcggatttgtcccactgcgtcggccggggaggcaaatgccatgccgatgctcaaaataccgatgcccaatgcgctgatgaaggaggattttttcacgatgtctttcctgaaaatggatgtgtatgtttattctgcggctttttccgcattgccgccctcagcgtttttctcggcgaagctggtcatgaatttaccgatcaggttttccagaaccattgcagaactggttacggagatggtgtcgccggcagcaaggttttccgtatcgccgccctgctgcagcccgatgtactgttcgcccaaaagtcccgaagtcaggatttgcgcggaaacgtcactgctgaactgatacttgccgtccaaatcaaggcgcaccctcgcctgataggatttcgggtcaagcccgatagcgccgacgcgcccgaccaatacgcctgcggatttgacgggggcattgaccttcaaaccgccgatgtcgccgaaatcggcataaacggcgtaagttttgtccgaaccgccgaacgccgcgccgcccgccacgcggaaagcgagaaaggcaaccgccgccgcgccgatcaagacgaacagtccgacccaaaattccaatatgttctttttcattaa

SEQ ID NO: 1580 - protein, 376 aa, Neisseria gonorrhoeae
MVCRLFAAVFGFQLGNQPVDAFGFDDFAELVAVHGNQARAFDGDVVGTVFAAALVGGKVHIDGLLTGDADFGTDDDFLAALIDDGIVFDVDGRVFEFQHRAGIGADQQGLKFFGQRLFLRVGRGTPRVADRQCGHTLEIEIGNRIGFGFWACRSRVAAFEDGQNLCGVLADLSHCVGRGGKCHADAQNTDAQCADEGGFFHDVFPENGCVCLFCGFFRIAALSVFLGEAGHEFTDQVFQNHCRTGYGDGVAGSKVFRIAALLQPDVLFAQKSRSQDLRGNVTAELILAVQIKAHPRLIGFRVKPDSADAPDQYACGFDGGIDLQTADVAEIGINGVSFVRTAERRAARHAESEKGNRRRADQDEQSDPKFQYVLFH

SEQ ID NO: 1581 - DNA, 1137 bp, Neisseria meningitidis
atggtttgtcggttatttgccgccgtttttggctttcaactcggcaatcagtccgtccacgcctttcgctttgataatttcgccgaattggttgcggtacacggtaaccaggctcgcgccttcgatggcgacgttgtaggtacggtatttaccgccgctttggtaggtggtgaagtccatgttgacgggtttttgcccgggtacgccgacttcggcgcggacgatgatttctttgccgcctttattgacgatgggattgtctttgacgttgacgttggcgttttttaatttcagcatcgtgccggaataggtgcggatcagcagggtttgaaattctttggccaacgcttgtttttgcgcgtcggacgcggtgcgccaagggttgccgaccgccaatgcggtcatacgttggaaatcgaaatagggaatcgcataggcttcggctttttggcgagcggtgttggcatcgccgttttttaagatgctcaatacttgagtggcgttttgacggatttggcttaccgcgtcggcaggggcggcaaatgccatgccgatgctcaaaataccgatgcccaatgcgctgatgagggaggattttttcatgattaagtgtcctagtttgaatatgatggcatacgtttattcggcggctttttccgcattgccgccgtcggcatttttctcggcaaaactcgtcatgaatttgccgataaggttttccagaaccattgcagaactggttacggagatggtgtcgccggcagcaaggttttccgtgtcgccgccctgctgcagcccgatgtactgctcgcccaaaagtcccgaagtcaggatttgcgcggaaacgtcgctgctgaactgatacttgccgtccaaatcgaggcgcaccctcgcctgataggatttcgggtcaagtccgatagcgccgacgcgcccgaccaatacgcctgcggatttgacgggggcattgaccttcaaaccgccgatgtcgccgaaatcggcataaacggcgtaagttttgtccgaaccgccgaacgccgcaccgccggccacgcggaaagcgagaaaggcaaccgccgccgcgccaatcaggacgaacagtccgacccaaaattccaatatgttcttcttcattaa

SEQ ID NO: 1582 - protein, 378 aa, Neisseria meningitidis
  misc_feature (96)..(96): Xaa can be any naturally occurring amino acid
  misc_feature (160)..(160): Xaa can be any naturally occurring amino acid
  misc_feature (203)..(203): Xaa can be any naturally occurring amino acid
  misc_feature (206)..(206): Xaa can be any naturally occurring amino acid
MVCRLFAAVFGFQLGNQSVHAFRFDNFAELVAVHGNQARAFDGDVVGTVFTAALVGGEVHVDGFLPGYADFGADDDFFAAFIDDGIVFDVDVGVFXFQHRAGIGADQQGLKFFGQRLFLRVGRGAPRVADRQCGHTLEIEIGNRIGFGFLASGVGIAVFXDAQYLSGVLTDLAYRVGRGGKCHADAQNTDAQCADEGGFFHDXVSXFEYDGIRLFGGFFRIAAVGIFLGKTRHEFADKVFQNHCRTGYGDGVAGSKVFRVAALLQPDVLLAQKSRSQDLRGNVAAELILAVQIEAHPRLIGFRVKSDSADAPDQYACGFDGGIDLQTADVAEIGINGVSFVRTAERRTAGHAESEKGNRRRANQDEQSDPKFQYVLLH

SEQ ID NO: 1583 - DNA, 1137 bp, Neisseria meningitidis
  misc_feature (29)..(29): n is a, c, g, or t
  misc_feature (44)..(44): n is a, c, g, or t
  misc_feature (201)..(202): n is a, c, g, or t
  misc_feature (253)..(253): n is a, c, g, or t
atggcttatggattacttgctgccgtttntagccttcaactcgncaatcagtccgtccacgcctttcgctttgataatttcgccgaattggttgcggtacacggtaaccaggctcgcgccttcgatggcgacgttgtaggtacggtatttaccgccgctttggtaggtggtgaagtccatgttgacgggtttttgcccggnnacgccgacttcggcgcggacgatgatttctttgccgcctttattgacgatnggattgtctttgacgttgacgttggcgttttttaatttcagcatcgtgccggaataggtgcggatcagcagggtttgaaattctttggccaacgcttgtttttgcgcgtcggacgcggtgcgccaagggttgccgaccgccaatgcggtcatacgttggaaatcgaaatagggaatcgcataggcttcggctttttggcgggcggtgttggcatcaccgctttttaagatgctcaatacttgagtggcgttttgacggatttggtttaccgcgtcggcaggggcggcaaatgccatgccgatgctcaaaataccgatgcccaatgcgctgatgaaggaggattttttcatgattaagtgtcctagtttgaatatgatggcatacgtttattcggcggctttttccgcattgccgccgtcggcatttttctcggcaaaactcgtcatgaatttgccgataaggttttccagaaccattgcagaactggttacggagatggtgtcgccggcagcaaggttttccgtgtcgccgccctgctgcagcccgatgtactgctcgcccaaaagtcccgaagtcaggatttgcgcggaaacgtcgctgctgaactgatacttgccgtccaaatcgaggcgcaccctcgcctgataggatttcgggtcaagtccgatagcgccgacgcgcccgaccaatacgcctgcggatttgacgggggcattgaccttcaaaccgccgatgtcgccgaaatcggcataaacggcgtaagttttgtccgaaccgccgaacgccgcaccgccggccacgcggaaagcgagaaaggcaaccgccgccgcgccaatcaggacgaacagtccgacccaaaattccaatatgttctttttcattaa

SEQ ID NO: 1584 - protein, 374 aa, Neisseria meningitidis
  misc_feature (10)..(10): Xaa can be any naturally occurring amino acid
  misc_feature (15)..(15): Xaa can be any naturally occurring amino acid
  misc_feature (68)..(68): Xaa can be any naturally occurring amino acid
  misc_feature (85)..(85): Xaa can be any naturally occurring amino acid
MAYGLLAAVXSLQLXNQSVHAFRFDNFAELVAVHGNQARAFDGDVVGTVFTAALVGGEVHVDGFLPGXADFGADDDFFAAFIDDXIVFDVDVGVFFQHRAGIGADQQGLKFFGQRLFLRVGRGAPRVADRQCGHTLEIEIGNRIGFGFLAGGVGITAFDAQYLSGVLTDLVYRVGRGGKCHADAQNTDAQCADEGGFFHDVSFEYDGIRLFGGFFRIAAVGIFLGKTRHEFADKVFQNHCRTGYGDGVAGSKVFRVAALLQPDVLLAQKSRSQDLRGNVAAELILAVQIEAHPRLIGFRVKSDSADAPDQYACGFDGGIDLQTADVAEIGINGVSFVRTAERRTAGHAESEKGNRRRANQDEQSDPKFQYVLFH

SEQ ID NO: 1585 - DNA, 489 bp, Neisseria gonorrhoeae
atgaaaaaaatactcaccgccgccgccgtcgcactgatcggcatcctcctcgccaccgtcctcatccccgacagtaaaaccgcgcccgccttctccctgcccgacctgcacggaaaaaccgtttccaacgccgacctgcaaggcaaagtcaccctgattaatttttggtttccctcctgtccgggttgtgtgagcgaaatgcccaaagtcaccaaaacggcaaacgactacaaaaataaagatttccaagtcctcgccgttgcccagcccatcgatccgatagaaagcgtccgccaatacgtcaaagactacggactgccgtttaccgtcatttatgatgcggacaaagccgtcggacaggcattcggcacacaggtttatccgacttccgtccttatcggcaaaaaaggcgaaatcctcaaaacttatgtcggcgaacccgatttcggcaaactctaccaagaaatcgataccgcgctggcgcaatag

SEQ ID NO: 1586 - protein, 162 aa, Neisseria gonorrhoeae
MKKILTAAAVALIGILLATVLIPDSKTAPAFSLPDLHGKTVSNADLQGKVTLINFWFPSCPGCVSEMPKVTKTANDYKNKDFQVLAVAQPIDPIESVRQYVKDYGLPFTVIYDADKAVGQAFGTQVYPTSVLIGKKGEILKTYVGEPDFGKLYQEIDTALAQ

SEQ ID NO: 1587 - DNA, 489 bp, Neisseria meningitidis
atgawaaaaatactcaccgccgccgtcgtcgcactgatcggcatcctccttgccatcgtcctcmtccccgacagcaaaaccgcgcccgccttctccmtgcccgacctgcacggaaaaaccgtttccaacgccgacctgcaaggcaaagtaaccctgattaatttttggtttccctcctgtccgggttgtgtgagcgawatgcccaaaatcattaaaacggcaaatgactataaaawcaaaaacttccaagtacttgccgtcgcccagcccatcgatccgatagaaagcgtccgccaatatgtcaaagactacggtttgccgtttaccgtcatgtatgatgcggacaaagctgtcggacaggcgttcggcacacaggtttatccgacttccgtccttatcggcaaataaggcgaaatcttcaaaacctacgtcggcgaacccgatttcggcaaactctaccaagaaatcgatacgcgcgtggcgcaatag

SEQ ID NO: 1588 - protein, 161 aa, Neisseria meningitidis
  misc_feature (2)..(2): Xaa can be any naturally occurring amino acid
  misc_feature (22)..(22): Xaa can be any naturally occurring amino acid
  misc_feature (33)..(33): Xaa can be any naturally occurring amino acid
  misc_feature (66)..(66): Xaa can be any naturally occurring amino acid
  misc_feature (79)..(79): Xaa can be any naturally occurring amino acid
MXKILTAAVVALIGILLAIVLXPDSKTAPAFSXPDLHGKTVSNADLQGKVTLINFWFPSCPGCVSXMPKIIKTANDYKXKNFQVLAVAQPIDPIESVRQYVKDYGLPFTVMYDADKAVGQAFGTQVYPTSVLIGKGEIFKTYVGEPDFGKLYQEIDTRVAQ

SEQ ID NO: 1589 - DNA, 489 bp, Neisseria meningitidis
  misc_feature (105)..(105): n is a, c, g, or t
  misc_feature (119)..(119): n is a, c, g, or t
  misc_feature (125)..(125): n is a, c, g, or t
  misc_feature (145)..(145): n is a, c, g, or t
  misc_feature (152)..(152): n is a, c, g, or t
  misc_feature (162)..(162): n is a, c, g, or t
  misc_feature (202)..(202): n is a, c, g, or t
  misc_feature (206)..(206): n is a, c, g, or t
atgaaaaaaatactcaccgccgccgtcgtcgcactgatcggcatcctccttgccatcgtcctcatccccgacagcaaaaccgcgcccgctttctccctgtccganctgcacggaaaaancgtttncaacgccgacctgcaaggcnaagttancctgattaanttttggtttccctcctgtccgggttgtgtgagcgaaatgnccanaatcattaaaacggcaaatgactataaaaacaaaaacttccaagtccttgccgtcgcccagcccatcgatccgatagaaagcgtccgccaatatgtcaaagactacggtttgccgtttaccgtcatgtatgatgcggacaaagctgtcggacaggcgttcggcacacaggtttatccgacttccgtccttatcggcaaaaaaggcgaaatcctcaaaacttatgtcggcgaacccgatttcggcaaactctaccaagaaatcgataccgcgctggcacaatag

SEQ ID NO: 1590 - protein, 162 aa, Neisseria meningitidis
  misc_feature (35)..(35): Xaa can be any naturally occurring amino acid
  misc_feature (40)..(40): Xaa can be any naturally occurring amino acid
  misc_feature (42)..(42): Xaa can be any naturally occurring amino acid
  misc_feature (49)..(49): Xaa can be any naturally occurring amino acid
  misc_feature (51)..(51): Xaa can be any naturally occurring amino acid
  misc_feature (54)..(54): Xaa can be any naturally occurring amino acid
  misc_feature (68)..(69): Xaa can be any naturally occurring amino acid
MKKILTAAVVALIGILLAIVLIPDSKTAPAFSLSXLHGKXVXNADLQGXVXLIXFWFPSCPGCVSEMXXIIKTANDYKNKNFQVLAVAQPIDPIESVRQYVKDYGLPFTVMYDADKAVGQAFGTQVYPTSVLIGKKGEILKTYVGEPDFGKLYQEIDTALAQ

SEQ ID NO: 1591 - DNA, 426 bp, Neisseria gonorrhoeae
atgttcgtagataacggatttaataaaacggtagcgagttttgcccaaatcgtcgaaactttcgacgtattcttctttaggaacgattgcgccttttttacgcagatgaaacagcggtgcggttgggtctgctcgttggtatatctcgttgatatatttacaagatgcggcttcgagattccgaaccgctcctttaaagagcttgggcttttgatacagataagtctgtcggaacgttttaggactaatgccgaagtcgagatggatgcccattacttccccttactcagaaaatatttaaaatttataatgttacatatagttacaaatattagagttttttgtgtgtgcgtcaaggaattgttgacaattttagttaaaaatttgtctccaaacggaaaaaagcggtttgttttttgttgttaa

SEQ ID NO: 1592 - protein, 141 aa, Neisseria gonorrhoeae
MFVDNGFNKTVASFAQIVETFDVFFFRNDCAFFTQMKQRCGWVCSLVYLVDIFTRCGFEIPNRSFKELGLLIQISLSERFRTNAEVEMDAHYFPLLRKYLKFIMLHIVTNIRVFCVCVKELLTILVKNLSPNGKKRFVFCC

SEQ ID NO: 1593 - DNA, 429 bp, Neisseria meningitidis
atgttcgtagataacggatttaataaaacggtagcgagttttgcccaaatcgtcgaaactttcgacgtattcttctttaggaacgattgcgccttttttacgcagatgaaacagcggtgcggttgggtctgctcgttggtatatctcgttgatatctttccaagatgcggattcgagattccgaaccgctcctttaaagagcttgggcttttgatacagataagtctgtcggaacgttttaggactaatgccgaagtcgagatggatgctcattacttccccttactcagaaaatatttaaaatttataatgttacatatatttacaaatattaaagttttttwttgtgtgtgcgtcaaggaattgttgacaattttagttaaaaatttgtctccaaacggaaaaaagcggtttgttttttgttgttaa

SEQ ID NO: 1594 - protein, 142 aa, Neisseria meningitidis
  misc_feature (115)..(115): Xaa can be any naturally occurring amino acid
MFVDNGFNKTVASFAQIVETFDVFFFRNDCAFFTQMKQRCGWVCSLVYLVDIFPRCGFEIPNRSFKELGLLIQISLSERFRTNAEVEMDAHYFPLLRKYLKFIMLHIFTNIKVFXCVCVKELLTILVKNLSPNGKKRFVFCC

SEQ ID NO: 1595 - DNA, 380 bp, Neisseria meningitidis
atgttcgtagataacggatttaataaaacggtagcgagttttgcccaaatcgtcgaaactttcgacgtattcttctttaggaacaattgcaccttttttacgcagatgaaacagcggtgcggttgggtctgctcgttggtatatctcgttgatatctttccaagatgcggcttcgagattccgaaccgctcctttaaagagcttgggcttttgatacagataagtctgtcggaacgttttaggactaatgccgaagtcgagatagatgctcattacttccccttactcagaaaatatttaaaatttataatgttacatatatttacaaatattaaagttttttttgtgtgtgcgtcaaggaattgttgacaattttagtt

SEQ ID NO: 1596 - protein, 127 aa, Neisseria meningitidis
  misc_feature (115)..(115): Xaa can be any naturally occurring amino acid
MFVDNGFNKTVASFAQIVETFDVFFFRNNCTFFTQMKQRCGWVCSLVYLVDIFPRCGFEIPNRSFKELGLLIQISLSERFRTNAEVEIDAHYFPLLRKYLKFIMLHIFTNIKVFXCVCVKELLTILV

SEQ ID NO: 1597 - DNA, 654 bp, Neisseria gonorrhoeae
atgttttccgtaccgcgttcctttttgccgggcgttttcgtacttgccgcgcttgccgcctgcaaacctcaagacaacagtgcggcgcaagccgcttcttcaagtgcatccgcgccggctgcggaaaatgcggcaaagccgcaaacgcgcggtacggatatgcgtaaggaagacatcggcggcgatttcacactgaccgacggcgaaggcaagcctttcagcctgagcgatttgaaaggcaaggtcgtgattctgtctttcggctttacgcactgtcccgatgtctgcccgacagggcttttgacgtacagcgacactttgaagcagttgggcgggcaggctaaggacgtgaaagtggtgttcgtcagcatcgatccggaacgcgacacgcctgaaatcatcggcaagtatgccaaacagttcaatccggactttatcggtctgacggcaacgggcggccaaaacctgccggtcatcaagcagcaataccgcgtggtttctgccaaaatcaatcaaaaagacgacagcgaaaactatttggtcgaccactcttccggtgcgtatcttatcgataaaaacggtgaggttgccattttctcgccttacggaagcgagccggaaacgattgctgccgatgtaaggaccctgctctga

SEQ ID NO: 1598 - protein, 217 aa, Neisseria gonorrhoeae
MFSVPRSFLPGVFVLAALAACKPQDNSAAQAASSSASAPAAENAAKPQTRGTDMRKEDIGGDFTLTDGEGKPFSLSDLKGKVVILSFGFTHCPDVCPTGLLTYSDTLKQLGGQAKDVKVVFVSIDPERDTPEIIGKYAKQFNPDFIGLTATGGQNLPVIKQQYRVVSAKINQKDDSENYLVDHSSGAYLIDKNGEVAIFSPYGSEPETIAADVRTLL

SEQ ID NO: 1599 - DNA, 654 bp, Neisseria meningitidis
  misc_feature (142)..(142): n is a, c, g, or t
atgttttccgtaccgcgttcctttttgccgggcgttttcgtacttgccgcgcttgccgcctgcaaacctcaagacaacagtgcggcgcaagtcgcttcttcaagtgcatccgcgtcggctgcggaaaatgcggcaaagcaanacacgcgcggtacggatatgcgtaaggaagacatcggcggcgatttcacgctgaccgacggcgaaggcaagcctttcaacctgagcgatttgaaaggcaaggtcgtgattctgtctttcggctttacgcactgtcccgatgtctgcccgacagagcttttgacgtacagcgacacgttgaagcagttgggcgggcaggctaaggacgtgaaagtggtgttcgtcagcatcgatccggaacgcgacacgcctgaaatcatcggcaagtatgccaaacagttcaatccggactttatcgstctgacggcaacgggcggccaaaacctgccggtcatcaagcagcaataccgcgtggtttctgccaaagtcaatcaaaamgacgacagcgaaaactatttggtcgaccactcttccggtgcgtatctcatcgacaaaaacggtgaggttgccattttctcgccttacggaagcgagccggaaacgattgctgccgatgtaaggaccctgctctga

SEQ ID NO: 1600 - protein, 217 aa, Neisseria meningitidis
  misc_feature (48)..(48): Xaa can be any naturally occurring amino acid
  misc_feature (147)..(147): Xaa can be any naturally occurring amino acid
  misc_feature (173)..(173): Xaa can be any naturally occurring amino acid
MFSVPRSFLPGVFVLAALAACKPQDNSAAQVASSSASASAAENAAKQXTRGTDMRKEDIGGDFTLTDGEGKPFNLSDLKGKVVILSFGFTHCPDVCPTELLTYSDTLKQLGGQAKDVKVVFVSIDPERDTPEIIGKYAKQFNPDFIXLTATGGQNLPVIKQQYRVVSAKVNQXDDSENYLVDHSSGAYLIDKNGEVAIFSPYGSEPETIAADVRTLL

SEQ ID NO: 1601 - DNA, 654 bp, Neisseria meningitidis
atgttttccgtaccgcgttcctttttgccgggcgttttcgtacttgccgcgcttgccgcctgcaaacctcaagacaacagtgcggcgcaagtcgcttcttcaagtgcatccgcgtcggctgcggaaaatgcggcaaagccgcaaacgcgcggtacggatatgcgtaaggaagacatcggcggcgatttcacgctgaccgacggcgaaggcaagcctttcaacctgagcgatttgaaaggcaaggtcgtgattctgtctttcggctttacgcactgtcccgatgtctgcccgacagagcttttgacgtacagcgacacgttgaagcagttgggcgggcaggctaaggacgtgaaagtggtgttcgtcagcatcgatccggaacgcgacacgcctgaaatcatcggcaagtatgccaaacagttcaatccggactttatcggtctgacggcaacgggcgaccaaaacctgccggtcatcaagcagcaataccgcgtggtttctgccaaagtcaatcaaaaagacgacagcgaaaactatttggtcgaccactcttccggtgcgtatctcatcgacaaaaacggtgaggttgccattttctcgccttacggaagcgagccggaaacgattgctgccgatgtaaggaccctgctctga

SEQ ID NO: 1602 - protein, 217 aa, Neisseria meningitidis
MFSVPRSFLPGVFVLAALAACKPQDNSAAQVASSSASASAAENAAKPQTRGTDMRKEDIGGDFTLTDGEGKPFNLSDLKGKVVILSFGFTHCPDVCPTELLTYSDTLKQLGGQAKDVKVVFVSIDPERDTPEIIGKYAKQFNPDFIGLTATGDQNLPVIKQQYRVVSAKVNQKDDSENYLVDHSSGAYLIDKNGEVAIFSPYGSEPETIAADVRTLL

SEQ ID NO: 1603 - DNA, 945 bp, Neisseria gonorrhoeae
atgataacggacaggtttcatctctttcattttccagtatctttcatttatcaatctgacaacaaaatgccgcctgaaaacagttcagacggcattttaaccacaaacggcttacagcttccattcgcccaacttggcagcgtaagcttccaaatctgcaatcggacgggttgccacgccgctttccatcgctgctttggcggcagccgtagcgacgcgaggcagcaggcgggaatcgaacggagtaggaatcaggtattccgcgccgaattcgaatttcttaccgtaagcggcaaccacttcttcggttacttcttccatcgccaaatctgccaaagcatacacgcaggcgcgtttcatttcttcgttgatggtggttgcgccgacatccaacgcgccccggaagatgaacgggaagcacaatacgttgttcacttggttcgggaagtcggagcggccggtaccgataaccacgtccggacgggtttctttcgccagcggcggcaggatttccggattcgggttggccatggcgaacacgatgggtttttcgttcatcgtgttcaacatttcaggcgtcagcaggtttgcgccggagaggcccaagaagatgtctttgcctttaaccgcatcggcaagtacgcgccggccgttgtcttcaacggcgtagaattttttggattcgtccatgcggtctttgtcttcgcgggtttggtaaatcacgcctttggagttgcaaacggttacgttttcacgtttcaagcccaaatccagcagttggttcaggcaggcaatcgcggcggcacctgcgccggagcacaccaaagtcgcttcttcgattttacggccggtataacgcagggcgttcaatacggcggcggcggtaatgatggccgtgccgtgctggtcatcatgaaatacggggattttgcagcgtttgcgtaa

SEQ ID NO: 1604 - protein, 314 aa, Neisseria gonorrhoeae
MITDRFHLFHFPVSFIYQSDNKMPPENSSDGILTTNGLQLPFAQLGSVSFQICNRTGCHAAFHRCFGGSRSDARQQAGIERSRNQVFRAEFEFLTVSGNHFFGYFFHRQICQSIHAGAFHFFVDGGCADIQRAPEDEREAQYVVHLVREVGAAGTDNHVRTGFFRQRRQDFRIRVGHGEHDGFFVHRVQHFRRQQVCAGEAQEDVFAFNRIGKYAPAVVFNGVEFFGFVHAVFVFAGLVNHAFGVANGYVFTFQAQIQQLVQAGNRGGTCAGAHQSRFFDFTAGITQGVQYGGGGNDGRAVLVIMKYGDFAAFA

SEQ ID NO: 1605 - DNA, 321 bp, Neisseria meningitidis
gacggcatcggcaagcacgcgctggccgttgtcttcaatggcgtagaactgtttggactcgtccatacggtctttgtcttcgcgggtttggtaaatcacgcctttggagtcgcaaacggtcacgttttcgcgtttcaagcccaaatccagcaattggwtcaagcaggcaatcgcggccgcacctgcgccggaacacaccaaagtcgcttcttcgattttacggccggtaaaacgcakggcgttcaatacggcggcggcggtaatgatggccgtgccgtgctggtcgtcgtggaatacggggattttgcagcgtttgcgtaa

SEQ ID NO: 1606 - protein, 106 aa, Neisseria meningitidis
  misc_feature (53)..(53): Xaa can be any naturally occurring amino acid
  misc_feature (79)..(79): Xaa can be any naturally occurring amino acid
DGIGKHALAVVFNGVELFGLVHTVFVFAGLVNHAFGVANGHVFAFQAQIQQLXQAGNRGRTCAGTHQSRFFDFTAGKTXGVQYGGGGNDGRAVLVVVEYGDFAAFA

SEQ ID NO: 1607 - DNA, 900 bp, Neisseria meningitidis
ctatatcaatctgacagcaaaatgccgcctgaaaacagttcagacggcattttaaccgcaaacggcttacagcttccattcgctcagcttggcagcgtaagcttccaaatctgcaatcggacgggttgccacgccgctttccatcgctgctttggcggcagccgtagcaacgcgcggcagcaggcgggaatcgaacggagtcggaatcaggtattccgcgccgaattcaaatttcttaccgtaagcggcaaccacttcttcggttacctcttccatcgccaaatccgccaaagcatacacgcaggcgcgtttcatttcttcgttgatggtcgtcgcgccgacatccaacgcaccgcggaagatgaacgggaagcacaatacattgttcacttggttcgggaagtcggagcggccggtaccgataaccacgtccggacgggtttctttcgccagcggcggcaggatttccggattcgggttggccatagcgaacacgatgggtttttcgttcatggtgttcagtatttcaggcgtcagcaggttcgcgccggagaggcccaagaagatgtctttgcctttgacggcatcggcaagcacgcgctggccgttgtcttcaatggcgtagaactgtttggactcgtccatacggtctttgtcttcgcgggtttggtaaatcacgcctttggagtcgcaaacggtcacgttttcgcgtttcaagcccaaatccagcaattggttcaagcaggcaatcgcggccgcacctgcgccggaacacaccaaagtcgcttcttcgattttacggccggtaaaacgcagggcgttcaatacggcagcggcggtaatgatggccgtgccgtgctggtcgtcgtggaatacggggattttgcagcgtttgcgtaa

SEQ ID NO: 1608 - protein, 299 aa, Neisseria meningitidis
LYQSDSKMPPENSSDGILTANGLQLPFAQLGSVSFQICNRTGCHAAFHRCFGGSRSNARQQAGIERSRNQVFRAEFKFLTVSGNHFFGYLFHRQIRQSIHAGAFHFFVDGRRADIQRTAEDEREAQYIVHLVREVGAAGTDNHVRTGFFRQRRQDFRIRVGHSEHDGFFVHGVQYFRRQQVRAGEAQEDVFAFDGIGKHALAVVFNGVELFGLVHTVFVFAGLVNHAFGVANGHVFAFQAQIQQLVQAGNRGRTCAGTHQSRFFDFTAGKTQGVQYGSGGNDGRAVLVVVEYGDFAAFA

SEQ ID NO: 1609 - DNA, 534 bp, Neisseria gonorrhoeae
atgaagctgaaaaccttgttattgcccttcgccgcactggcattgtgtgccaacgcatttgccgccccgcccggcgacgcgtcgttggcacgttggctggatacgcagaatttcgaccgggatatagaaaaaaatatgattgaaggctttaatgccggatttaaaccgtatgcggacaaagcccttgccgaaatgccggaagcgaaaaaagatcaggcggcagaagcctttaatcgttatcgtgagaatgttttgaaagatttgattacgcccgaagtgaaacaggctgtccgcaataccttattgaagaatgcccgtgaaatatacacgcaagaagaaattgacggcatgattgccttttacggttcgcctgtcggtcagtccgtcgttgccaaaaatccgcgcttaatcaagaaatcgatgagtgaaatagcggtatcttggactgcattgtcagggaaaatcgcgcgacatcatctgcccgagtttacggaagagttacggcgcatcatctgcggcggtatagtggattaa

SEQ ID NO: 1610 - protein, 177 aa, Neisseria gonorrhoeae
MKLKTLLLPFAALALCANAFAAPPGDASLARWLDTQNFDRDIEKNMIEGFNAGFKPYADKALAEMPEAKKDQAAEAFNRYRENVLKDLITPEVKQAVRNTLLKNAREIYTQEEIDGMIAFYGSPVGQSVVAKNPRLIKKSMSEIAVSWTALSGKIARHHLPEFTEELRRIICGGIVD

SEQ ID NO: 1611 - DNA, 582 bp, Neisseria meningitidis
attaaactgaaaaccttgttattgcccttcgccacgctggcattgtgcaccaatgcttttgccgccccgcccagcgacgcgtcgttggcgcgttggctggatacgcagaattttgaccgggatatagaaaaaaatatgattgagggctttaatgccggatttaaaccgtatgcggacaaagcccttgccgaaatgccggaagcgaaaaaagatcaggcggcagaagcctttaaccgttatcgtgagaatgttttgaaagatttgattacgcccgaagtgaaacaggctgtccgcaatactttattgaagaatgcccgtgagatatacacgcaagaagaaattgacggcatgattgccttttacggttcgcctgtcggtcagtccgtcgttgccaaaaatccgcgcttaatcaagaaatcgatgagtgaaatagcggtatcttggactgcattgtcagggaaaatcgcgcaacatcatctgcccgagtttacggaagagttgcggcgcatcatctgcggcggtaaaaatcccgatgcgggctgtaaacaagccggacaggttgggaaaaggcatcagaaataa

SEQ ID NO: 1612 - protein, 193 aa, Neisseria meningitidis
IKLKTLLLPFATLALCTNAFAAPPSDASLARWLDTQNFDRDIEKNMIEGFNAGFKPYADKALAEMPEAKKDQAAEAFNRYRENVLKDLITPEVKQAVRNTLLKNAREIYTQEEIDGMIAFYGSPVGQSVVAKNPRLIKKSMSEIAVSWTALSGKIAQHHLPEFTEELRRIICGGKNPDAGCKQAGQVGKRHQK

SEQ ID NO: 1613 - DNA, 582 bp, Neisseria meningitidis; identical to SEQ ID NO: 1611

SEQ ID NO: 1614 - protein, 193 aa, Neisseria meningitidis; identical to SEQ ID NO: 1612

SEQ ID NO: 1615 - DNA, 588 bp, Neisseria meningitidis
ttgaatattaaactgaaaaccttgttattgcccttcgccacgctggcattgtgcaccaatgcttttgccgccccgcccagcgacgcgtcgttggcgcgttggctggatacgcagaattttgaccgggatatagaaaaaaatatgattgagggctttaatgccggatttaaaccgtatgcggacaaagcccttgccgaaatgccggaagcgaaaaaagatcaggcggcagaagcctttaaccgttatcgtgagaatgttttgaaagatttgattacgcccgaagtgaaacaggctgtccgcaatactttattgaagaatgcccgtgagatatacacgcaagaagaaattgacggcatgattgccttttacggttcgcctgtcggtcagtccgtcgttgccaaaaatccgcgcttaatcaagaaatcgatgagtgaaatagcggtatcttggactgcattgtcagggaaaatcgcgcaacatcatctgcccgagtttacggaagagttgcggcgcatcatctgcggcggtaaaaatcccgatgcgggctgtaaacaagccggacaggttgggaaaaggcatcagaaataa

SEQ ID NO: 1616 - protein, 195 aa, Neisseria meningitidis
LNIKLKTLLLPFATLALCTNAFAAPPSDASLARWLDTQNFDRDIEKNMIEGFNAGFKPYADKALAEMPEAKKDQAAEAFNRYRENVLKDLITPEVKQAVRNTLLKNAREIYTQEEIDGMIAFYGSPVGQSVVAKNPRLIKKSMSEIAVSWTALSGKIAQHHLPEFTEELRRIICGGKNPDAGCKQAGQVGKRHQK

SEQ ID NO: 1617 - DNA, 588 bp, Neisseria meningitidis; identical to SEQ ID NO: 1615

SEQ ID NO: 1618 - protein, 195 aa, Neisseria meningitidis; identical to SEQ ID NO: 1616

SEQ ID NO: 1619 - DNA, 792 bp, Neisseria gonorrhoeae
atggattatctgcaaaacctgtctttgggcttgacaaaaaagctgcccgttatactgcaaacagaagtagcggagtgtggcttggcatgtctagcggctgtggccggattttatggtttctatacggatttgcgcgcactgcgttcaaaatactgtctgtcacttaagggtgagaatttggcagatattgttcgttttgctgatgatatggggctgacgggacgggcgttgaggctggatttagacgaattgggcagtttgcgcctgccctgtattctacattgggatttgaatcattttgtggtgctggaatcggtatcttcggacggggctgccgtcatggatccggcttcgggacgacgcaaagtcaagacggaggaaatatcgcgcaagtttacgggaattgctttggaactgtggccaaacacgcgtttcgaggcaggggaagaaaagcaggaaatccgcatcctacccatgttgcgcgggatttctgggctggggcggacattgtttcagcttttggctttggcagcagcaatggaagtgtttgcttttttacaaaacgtcagcttcaagatcggacgtggtgaatcgcttgcgttaatcggacgatcgggctgcggtaaatcgacacttttggatattttaagcggcaatctacctcccgaatcaggcaaagtcatgataaatgggcacgacatttacagcttaccgccaccttttattccgcaatttgagtgcgatggtcaaggcaggacgatgttttatagtggattaaatttaaaccggtag

SEQ ID NO: 1620 - protein, 263 aa, Neisseria gonorrhoeae
MDYLQNLSLGLTKKLPVILQTEVAECGLACLAAVAGFYGFYTDLRALRSKYCLSLKGENLADIVRFADDMGLTGRALRLDLDELGSLRLPCILHWDLNHFVVLESVSSDGAAVMDPASGRRKVKTEEISRKFTGIALELWPNTRFEAGEEKQEIRILPMLRGISGLGRTLFQLLALAAAMEVFAFLQNVSFKIGRGESLALIGRSGCGKSTLLDILSGNLPPESGKVMINGHDIYSLPPPFIPQFECDGQGRTMFYSGLNLNR

SEQ ID NO: 1621 - DNA, 554 bp, Neisseria meningitidis
atggattatttatcaagactgtcctttggatttaacaaaaagctacctgtcattctgcaaacagaagttgctgaatgtggtttagcatgcctgacatccatcttgtcctattatggctttcacactgatttaagaacgttacgccaaaaatacaccctgtcattaaagggcgcaaatcttgcagacatcatgagatttggcaatgaaatgaatttaacgccacgagctttgcgtttagagttagatgagctgtcaaatttacaactaccctgcattctccattggaacttaaaccattttgttgtactttgttccatttccaaagacagtatcgtcattatggaccctgctgtcggtatgcgaaaaatcaaaatggacgaagtttcacaaaaattcacagggattgccctagaattattccccaatacccattttgaagagaaaaaagaaacaaagaaaatcaaaatattatctctattaagggggggtcaggcttaaaacgctctttaattcaaatgcttatattagctatttctttggaagtctttgcattg

SEQ ID NO: 1622 - protein, 185 aa, Neisseria meningitidis
  misc_feature (163)..(163): Xaa can be any naturally occurring amino acid
MDYLSRLSFGFNKKLPVILQTEVAECGLACLTSILSYYGFHTDLRTLRQKYTLSLKGANLADIMRFGNEMNLTPRALRLELDELSNLQLPCILHWNLNHFVVLCSISKDSIVIMDPAVGMRKIKMDEVSQKFTGIALELFPNTHFEEKKETKKIKILSLLRGXSGLKRSLIQMLILAISLEVFAL

SEQ ID NO: 1623 - DNA, 153 bp, Neisseria meningitidis
atgccccatctgcaaaacctgtctttgggcttaaagaaaaagctgcctgttatcctgcaaacagaaatatcagaatgcggcttggcatgtctggcggctgtggcgggatttcatggtttccatacgaatttacgcgcactgcgttcaaaatac

SEQ ID NO: 1624 - protein, 51 aa, Neisseria meningitidis
MPHLQNLSLGLKKKLPVILQTEISECGLACLAAVAGFHGFHTNLRALRSKY

SEQ ID NO: 1625 - DNA, 1170 bp, Neisseria meningitidis
atgacagcacataaaatcctgcccgtccttcttcccatcatcttaggcgtttctcacgcaacggctgcatcgcccgcgcccaacagaccgacggtacacgccgcccccacgctccaaacacccgaaaccctcacggcggcacacatcgttatcgaccttcaaagcaggcagactttatccgccaaaaacaccaatacccctgtcgaaccggcggcactaacccaactgatgaccgcatatttggttttcaaaaacatgaaatcgggaaatatccaatctgaagaaaacttaaaaatacccgaatccgcatgggcttcagaaggaagcagaatgtttgtacgtcccggcgatacggtcagcaccgacaaactcttaaaaggcatgattgccctatgcgcaaacgatgccgccctaacccttgccgaccggctgggcaacggctcgattgaaaattttgtgcaacaaatgaacaaagaagcccgacgcttgggcatgaagaacaccgtattcaaaaacccgacaggcttgggtagagaaggacaggtttccaccgccaaagacctctccctgctgtctgaagcattgatgcgcgactttccggaatattacccgctgttttccatcaaatcgttcaagtttgaaaacatagaacaaaacaaccgcaatatccttttatatagggacaacaatgtaaacggcctgaaagccgggcacacagaaagcggcggctacaaccttgccgtgtcatactccggcaacggcaggcacatccttgtcatcacactaggttcggaatcggcggaaacccgcgcatcggacaacagcaagctgctgaaccgggcattgcaggccttcgatacgcccaaaatatatccgaaaggcaaaaccgttgcccaaatccaaatttccggaggcagcaaaaaaaccgtccgcgcaggcttcctcaaagaagcctacatcactctgccacataaagaagcgaaaatggcagaacagattttggaaaccatacagccgattcccgccccggtaaaaaaagggcagattttaggaaaaatcaaaatcaggcaaaacggacataccattgccgaaaaagaaatcgtcgcactggaaaacgtagaaaaaagaagccggtggcaaaggctttggacgcgtctgacagggcagtaa

SEQ ID NO: 1626 - protein, 389 aa, Neisseria gonorrhoeae
MTAHKILPVLLPIILGVSHATAASPAPNRPTVHAAPTLQTPETLTAAHIVIDLQSRQTLSAKNTNTPVEPAALTQLMTAYLVFKNMKSGNIQSEENLKIPESAWASEGSRMFVRPGDTVSTDKLLKGMIALCANDAALTLADRLGNGSIENFVQQMNKEARRLGMKNTVFKNPTGLGREGQVSTAKDLSLLSEALMRDFPEYYPLFSIKSFKFENIEQNNRNILLYRDNNVNGLKAGHTESGGYNLAVSYSGNGRHILVITLGSESAETRASDNSKLLNRALQAFDTPKIYPKGKTVAQIQISGGSKKTVRAGFLKEAYITLPHKEAKMAEQILETIQPIPAPVKKGQILGKIKIRQNGHTIAEKEIVALENVEKRSRWQRLWTRLTGQ

SEQ ID NO: 1627 - DNA, 1170 bp, Neisseria meningitidis
atgacagcacataaaatcctgcccgtcctgctttccatcatcttaggcgtttctcacgcaacggctgcatcgcccgcgcccaacagaccgacggtacacgccgcccccacgttccaaacacccgaaaccctcacagcggcacacatcgttatcgaccttcaaagcaaacagattttatccgccaaaaacatcaatacccctgttgaaccggcggcactaacccaactgatgaccgcatatctggttttcaaaaacatgaaatcgggcaatatccaatctgaagaaaacttaaaaatacccgaatccgcatgggcttcagaaggaagcagaatgtttgtacgtcccggcgatacggtcagcaccgacaaactcttaaaaggcatgattgcactatccgcaaacgatgccgccctaacccttgccggccggctgggcaacggctcgattgaaaattttgtgcaacaaatgaacaaagaagcccgacgcttgggcatgaagaacactgtattcaaaaacccgacaggcttgagtagagaaggacaggtttccaccgccaaagacctcgccctgctgtctgaagcattgatgcgcgactttccggaatattacccgctgttttccatcaaatctttcaaattcaaaaatatagaacaaaacaaccgcaatatccttttatatagggacaacaatgtaaacggtctgaaagccggacacacagaaagcggcggctacaaccttgccgtgtcatactccggcaacggcaggcacatccttgtcatcacattgggttcggaatcggcggaaacacgcgcatcagacaacagcaagctgctgaactgggcattgcaggccttcgatacgcccaaaatatatccgaaaggcaaaaccgttgcccaaatccaaatttccggaggcagcaaaaaaaccgtccgcgcaggcttcctcaaagaagcctacatcactctgccacataaggaagcgaaaatggcagaacaaattctagaaaccatacagccgattcccgccccagtaaaaaaagggcaaattttaggaaaaatcaaaatcagacaaaacggatacaccattgccgaaaaagaaatcgtcgcactggaaaatgtaaaaaaaagaagccggtggcaaaggctttgggcgtgtctgacagggcagtaa

SEQ ID NO: 1628 - protein, 389 aa, Neisseria meningitidis
MTAHKILPVLLSIILGVSHATAASPAPNRPTVHAAPTFQTPETLTAAHIVIDLQSKQILSAKNINTPVEPAALTQLMTAYLVFKNMKSGNIQSEENLKIPESAWASEGSRMFVRPGDTVSTDKLLKGMIALSANDAALTLAGRLGNGSIENFVQQMNKEARRLGMKNTVFKNPTGLSREGQVSTAKDLALLSEALMRDFPEYYPLFSIKSFKFKNIEQNNRNILLYRDNNVNGLKAGHTESGGYNLAVSYSGNGRHILVITLGSESAETRASDNSKLLNWALQAFDTPKIYPKGKTVAQIQISGGSKKTVRAGFLKEAYITLPHKEAKMAEQILETIQPIPAPVKKGQILGKIKIRQNGYTIAEKEIVALENVKKRSRWQRLWACLTGQ

SEQ ID NO: 1629 - DNA, 1170 bp, Neisseria meningitidis
atgacagcacataaaatcctgcccgtcctgctttccatcatcttaggcgtttctcacgcaacggctgcatcgcccgcgcccaacagaccgacggcacacgccgcccccacgttccaaacacccgaaaccctcacagcggcacacatcgttatcgaccttcaaagcaaacagattttatccgccaaaaacatcaatacccctgtcgaaccggcggcactaacccaactgatgaccgcatatctggttttcaaaaacatgaaatcgggaaatatccgatctgaagaaaacttaaaaatacccgaatccgcatgggcttcagaaggaagcagaatgtttgtacgtcccggcgatacggtcagcaccgacaaactcttaaaaggcatgattgcactatccgcaaacgatgccgccctaacccttgccggccggctgggcaacggctcgattgaaaattttgtgcaacaaatgaacaaagaagcccgacgcttgggcatgaagaacactgtattcaaaaatccgacaggcttgagtagagaaggacaggtttccaccgccaaagacctcgcccagctgtctgaagcattgatgcgcgactttccggaatattacccgctgttttccatcaaatctttcaaattcaaaaatatagagcaaaacaaccgcaatatccttttatatagggacaacaatgtaaacggtctgaaagccggacacacagaaagcggcggctacaaccttgccgtgtcatactccggcaacggcaggcacatccttgtcatcacattgggttcggaatcggcggaaacacgcgcatcagacaacagcaagctgctgaactgggcattgcaagccttcgatacgcccaaaatatatccgaaaggcaaaaccgttgcccaaatccaaatttccggaggcagcaaaaaaaccgtccgcgcaggcttcctcaaagaagcctacatcactctgccacataaggaagcgaaaatggcagaacaaattctagaaaccatacagccgattcccgccccagtaaaaaaagggcaaattttaggaaaaatcaaaatcagacaaaacggatacaccattgccgaaaaagaaatcgtcgcactggaaaatgtaaaaaaaagaagccggtggcaaaggctttgggcgtgtctgacagggcagtaa

SEQ ID NO: 1630 - protein, 389 aa, Neisseria meningitidis
MTAHKILPVLLSIILGVSHATAASPAPNRPTAHAAPTFQTPETLTAAHIVIDLQSKQILSAKNINTPVEPAALTQLMTAYLVFKNMKSGNIRSEENLKIPESAWASEGSRMFVRPGDTVSTDKLLKGMIALSANDAALTLAGRLGNGSIENFVQQMNKEARRLGMKNTVFKNPTGLSREGQVSTAKDLAQLSEALMRDFPEYYPLFSIKSFKFKNIEQNNRNILLYRDNNVNGLKAGHTESGGYNLAVSYSGNGRHILVITLGSESAETRASDNSKLLNWALQAFDTPKIYPKGKTVAQIQISGGSKKTVRAGFLKEAYITLPHKEAKMAEQILETIQPIPAPVKKGQILGKIKIRQNGYTIAEKEIVALENVKKRSRWQRLWACLTGQ

SEQ ID NO: 1631 - DNA, 420 bp, Neisseria gonorrhoeae
atggacaataagaccaaactgcgcttgggcggcctgattttactgaccaccgccgttttaagcctcattatcgtattgattgtcgattcctggccgcttgccatcctgcttgccgccgtcatcgtcgccgccgctgcgggcggctttgtttggacatcccgccgacagcaacgccagtttatcgaacgtctgaaaaaattcgacatcgatcccgaaaaaggcagaatcaacgaggcaaacctgcgccgtatgtaccacagcggcggacaacaccagaaagatgcgattaccctgatctgcctgtcgcaaaaatgttcggtggacgaggcgcacgctatgttcaaaaaacgcccgacacgtcaggaaatcaatcaaatggcggcaaaacagtcgcgcggtcagaaacgtccgcaccgttaa

SEQ ID NO: 1632 - protein, 139 aa, Neisseria gonorrhoeae
MDNKTKLRLGGLILLTTAVLSLIIVLIVDSWPLAILLAAVIVAAAAGGFVWTSRRQQRQFIERLKKFDIDPEKGRINEANLRRMYHSGGQHQKDAITLICLSQKCSVDEAHAMFKKRPTRQEINQMAAKQSRGQKRPHR

SEQ ID NO: 1633 - DNA, 420 bp, Neisseria meningitidis
atggacaataagaccaaactgcgcttgggcggcctgattttactgaccaccgccgttttaagcctcattatcgtattgattgtcgattcctggccgcttgccatcctgcttgcagccgtcattgtcgctgccgctgcgggcggttttgtttggacatcccgccgacagcaacgccagtttatcgaacgcctgaaaaaattcgacatcgatcccgaaaaaggcagaatcaacgaggcaaacctgcgccgtatgtaccacagcggcggacaacaccagaaagatgcgattaccctgatctgcctgtcgcaaaaatgttcggtggacgaggcgcacgctatgttcaaaaaacgcccgacacgtcaggaaatcaatcaaatggcggcaaaacagtcgcgcggtcagaaacgtccgcaccgttaa

SEQ ID NO: 1634 - protein, 139 aa, Neisseria meningitidis; identical to SEQ ID NO: 1632

SEQ ID NO: 1635 - DNA, 420 bp, Neisseria meningitidis
atggacaataagaccaaactgcgcttgggcggcctgattttactgaccaccgccgttttaagcctcattatcgtattgattgtcgattcctggccgcttgccatcctgcttgccgccgtcatcgtcgccgccgctgcgggcggctttgtttggacatcccgccgacagcaacgccagtttatcgaacgtctgaaaaaattcgacatcgatcccgaaaaaggcagaatcaacgaggcaaacctgcgccgtatgtaccacagcggcggacaacaccaaaaagatgcgattaccctgatctgcctgtcgcaaaaatgttcggtggacgaggcgcacgctatgttcaaaaaacgcccgacacgtcaggaaatcaatcaaatggcggcaaaacagtcgcgcggtcagaaacgtccgcaccgttaa

SEQ ID NO: 1636 - protein, 139 aa, Neisseria meningitidis; identical to SEQ ID NO: 1632

SEQ ID NO: 1637 - DNA, 480 bp, Neisseria gonorrhoeae
atgaacaaaatattccttactgccgcagccttggtgctgggcgcgtgcggtttccacctgaaaggtgcagacggcatttctccgccgctgacctaccggagctggcacatcgaaggcggacaggcattgcaatttcctttggaaaccgcgctgtatcaggcttcgggcagggtggacgatgctgccggcgcgcagatgaccctgcgtatagacagcgtttcccaaaacaaggaaacctataccgttacccgtgcggcagtcatcaacgaatatcttttgatattgacggttgaagcgcaggtattgaaacgcggcgagccggtcggcaaaccgatgaccgtgtccgtccgccgcattttggattatgccgacaacgaaattttgggcaaacaggaagaagaagaaaccctgtgggcggaaatgcggcaggatgttgccgaacagattgtccgccgcctgacctttctgaaggcggaatga

SEQ ID NO: 1638 - protein, 159 aa, Neisseria gonorrhoeae
MNKIFLTAAALVLGACGFHLKGADGISPPLTYRSWHIEGGQALQFPLETALYQASGRVDDAAGAQMTLRIDSVSQNKETYTVTRAAVINEYLLILTVEAQVLKRGEPVGKPMTVSVRRILDYADNEILGKQEEEETLWAEMRQDVAEQIVRRLTFLKAE

SEQ ID NO: 1639 - DNA, 480 bp, Neisseria meningitidis
atgaacaaactgtttcttactgccgcagtgctgatgctgggcgcgtgcggtttccacctgaaaggtgcagacggcatttctccgccgctgacctaccggagctggcacatcgaaggcggacaggcattgcggtttcctttggaaaccgcgctgtatcaggcttcgggcagggtggacgatgctgccggcgcgcagatgaccctgcgtatagacagcgtttcccaaaacaaggaaacctacaccgttacccgtgcggcagtcatcaacgaatatcttttgatattgacggttgaagcgcaggtattgaaacgcggcgagccggtcggtaaaccgatgaccgtgtccgtccgccgcgtccttgcttatgccgacaacgagatcttgggcaaacaggaagaggaagcggcattgtgggcggaaatgcggcaggatgccgccgaacagattgtccgccgcctgacctttctgaaggcggaatga

SEQ ID NO: 1640 - protein, 159 aa, Neisseria meningitidis
MNKLFLTAAVLMLGACGFHLKGADGISPPLTYRSWHIEGGQALRFPLETALYQASGRVDDAAGAQMTLRIDSVSQNKETYTVTRAAVINEYLLILTVEAQVLKRGEPVGKPMTVSVRRVLAYADNEILGKQEEEAALWAEMRQDAAEQIVRRLTFLKAE

SEQ ID NO: 1641 - DNA, 480 bp, Neisseria meningitidis
atgaacaaactgtttcttactgccgcagtgctgatgctgggcgcgtgcggtttccacctgaaaggtgcagacggcatttctccgccgctgacctaccggagctggcacatcgaaggcggacaggcattgcagtttcctttggaaaccgcgctgtatcaggcttcgggtagggtggacgatgctgccggcgcgcagatgaccctgcgtatagacagcgtttcccaaaacaaggaaacctacaccgttacccgtgcggcagtcatcaacgaatatcttttgatattgacggttgaagcgcaggtattgaaacgcggcgagccggtcggcaaaccgatgaccgtgtccgtccgccgcgtccttgcttatgccgacaacgagatcttgggcaaacaggaagaggaagcggcattgtgggcggaaatgcggcaggatgccgccgaacagattgtccgccgcctgacctttctgaaggcggaatga

SEQ ID NO: 1642 - protein, 159 aa, Neisseria meningitidis
MNKLFLTAAVLMLGACGFHLKGADGISPPLTYRSWHIEGGQALQFPLETALYQASGRVDDAAGAQMTLRIDSVSQNKETYTVTRAAVINEYLLILTVEAQVLKRGEPVGKPMTVSVRRVLAYADNEILGKQEEEAALWAEMRQDAAEQIVRRLTFLKAE

SEQ ID NO: 1643 - DNA, 321 bp, Neisseria gonorrhoeae
atggatgcttgttttttcgtcattcccgcacaggcgggaattcggagattcgggattgttttcaaacgttcgggtcggattcttgccggtgcgggaatgatgcccttatatactttctccgagctttatatgcttcaacaggggacggcacatcaagcaccgcactgcgtgttgcccgaacgaggctgccctccgattagattctatcgctataaacagacgggtttcaaccgaaaaggaatggggataaagtccatttccgacacctctcgggcgatgccgtctgaaaaccaatctccactttcagacggcattgtttag

SEQ ID NO: 1644 - protein, 106 aa, Neisseria gonorrhoeae
MDACFFVIPAQAGIRRFGIVFKRSGRILAGAGMMPLYTFSELYMLQQGTAHQAPHCVLPERGCPPIRFYRYKQTGFNRKGMGIKSISDTSRAMPSENQSPLSDGIV

SEQ ID NO: 1645 - DNA, 321 bp, Neisseria meningitidis
atgaatgcttgttttttcgtcattcccacacaggcgggaattcggagattcgggattgttttcaaacgttcgggtcggattcttgccggtgcaggaatgatgcccttatatactttctccgagctttatatgtttcaacaggggacggcacatcaagcaccgcactgcgtgttgcccgaacgagactaccctccgattagattctatcgccataaacagacgggtttcaaccgaaaaggaatggggataaagtccatttccgacatctstcgggcgatgccgtctgaaaaccaatctccactttcagacggcattgtttag

SEQ ID NO: 1646 - protein, 106 aa, Neisseria meningitidis
  misc_feature (90)..(90): Xaa can be any naturally occurring amino acid
MNACFFVIPTQAGIRRFGIVFKRSGRILAGAGMMPLYTFSELYMFQQGTAHQAPHCVLPERDYPPIRFYRHKQTGFNRKGMGIKSISDIXRAMPSENQSPLSDGIV

SEQ ID NO: 1647 - DNA, 426 bp, Neisseria meningitidis
atgaatgcttgttttttcgtcattcccacacaggcgggaattcggagattcgggattgttttcaaacgttcgggtcggattcttgccggtgcgggaatgatgcccttatatatagtggattaaatttaaatcaggacaaggcgacgaagccgcagacagtacaaatagtacggcaaggcgaggcaacgccgtactggtttaaatttaatccactatactttctccgagctttatatgtttcaacagaggacggcacatcaagcaccgcactgcgtgttgcccgaacgagactgccctccgattagattctatcgctataaacagacgggtttcaaccgaaaaggaatgggaatgaagtccgtttccgacacctctcgggcgatgccgtctgaaaaccaatctccactttcagacggcattgtttag

SEQ ID NO: 1648 - protein, 138 aa, Neisseria meningitidis
MNACFFVIPTQAGIRRFGIVFKRSGRILAGAGMMPLYIVDIIRTRRRSRRQYKYGKARQRRTGLNLIHYTFSELYMFQQRTAHQAPHCVLPERDCPPIRFYRYKQTGFNRKGMGMKSVSDTSRAMPSENQSPLSDGIV

SEQ ID NO: 1649 - DNA, 744 bp, Neisseria gonorrhoeae
atgctcatcatccgcaacctgatttactggctgatactctgttccagcctgattttcctctttccctttatgctgctcgcctcgcctttccgggacggggcgcacaagatggcgcgggtctgggtcggcatcctcaactggtcgctcaaacacatcgtcgggctcaaataccgcatcatcggcgcggaacacattccggaccgcccctccgtcatctgcgccaaacaccaaagcggctgggaaacgctcgcgctccaagagatttttccgccgcaggtttacgttgccaagcgcgagttgttcaaaatcccctttttcggctggggcttgaaactggtcaaaaccataggcatagaccgcaacaaccgccgcgaagccaacgaacagctcataaaacagggtttggcgcgcaaaaacgaaggttattggattaccattttccccgaaggcacgcgccttgcgcccggaaaacgcggcaaatacaaactcggcggcgcgcgcatggcgaaaatgtttgagatggacatcgtccccgtcgccctcaacagcggcgaattttggccgaaaaattcctttctgaaatatccgggggaaatcaccgtcatcatctgtccgaccatcccgcacgcaagcggcagcgaagccgaattgatggaaaaatgcgaacacctcattgaaacgcaacaaccgcttatttccggcgcaggcccgtttgccgccgaaatgccgtctgaaaccgcatga

SEQ ID NO: 1650 - protein, 246 aa, Neisseria gonorrhoeae
MLIIRNLIYWLILCSSLIFLFPFMLLASPFRDGAHKMARVWVGILNWSLKHIVGLKYRIIGAEHIPDRPSVICAKHQSGWETLALQEIFPPQVYVAKRELFKIPFFGWGLKLVKTIGIDRNNRREANEQLIKQGLARKNEGYWITIFPEGTRLAPGKRGKYKLGGARMAKMFEMDIVPVALNSGEFWPKNSFLKYPGEITVIICPTIPHASGSEAELMEKCEHLIETQQPLISGAGPFAAEMPSET

SEQ ID NO: 1651 - DNA, 744 bp, Neisseria gonorrhoeae
atgctcatcatccgcaacctgatttactggctgatactctgttccaccctgattttcctctttccctttatgctgctcgcctcgcctttccgggacggggcgcacaagatggcgcgggtctgggtcggcattctcaactggtcgctcaaacacatcgtcgggctcaaataccgcatcatcggcgcggaaaacatccccgaccgccccgccgtcatctgcgccaaacaccaaagcggctgggaaacgctcgcccttcaggacatttttccgccgcaggtttacgttgccaaacgcgagttgttcaaaatcccctttttcggctggggcttgaaactggtcaaaaccataggcatagaccgcaacaaccgccgcgaagccaacgagcagctcataaaacaggggttggtgcgcaaaaacgaaggctattggattaccattttccccgaaggcacgcgccttgcgcccggaaaacgcggcaaatacaaactcggcggcgcgcgcatggcgaaaatgtttgagatggacatcgtccccgtcgccctcaacagcggcgaattttggccgaaaaactcctttctgaaatatccgggggaaatcaccgtcgtcatctgtccgaccatcccgcacgcaagcggcagcgaagccgaattgatggaaaaatgcgaacatctcatcgaaacgcaacaaccgcttatttccggcgcaggcccgtttgccgccaaaatgccgtctgaaaccgcatga

SEQ ID NO: 1652 - protein, 247 aa, Neisseria meningitidis
MLIIRNLIYWLILCSTLIFLFPFMLLASPFRDGAHKMARVWVGILNWSLKHIVGLKYRIIGAENIPDRPAVICAKHQSGWETLALQDIFPPQVYVAKRELFKIPFFGWGLKLVKTIGIDRNNRREANEQLIKQGLVRKNEGYWITIFPEGTRLAPGKRGKYKLGGARMAKMFEMDIVPVALNSGEFWPKNSFLKYPGEITVVICPTIPHASGSEAELMEKCEHLIETQQPLISGAGPFAAKMPSETA

SEQ ID NO: 1653 - DNA, 744 bp, Neisseria meningitidis
atgctcatcatccgcaacctgatttactggctgatactctgttccaccctgattttcctctttccctttatgctgctcgcctcgcctttccgagacggggcgcacaagatggcgcgggtctgggtcaaaatcctcaacctctcgctcaaacacatcgtcgggctcaaataccgcatcatcggcgcggaaaacatccccgaccgccccgccgtcatctgcgccaaacaccaaagcggctgggaaacgctcgcccttcaggacatttttccgccgcaggtttacgttgccaaacgcgagttgttcaaaatcccctttttcggctggggcttgaaactggtcaaaaccataggcatagaccgcaacaaccgccgcgaagccaacgagcagctcataaaacaggggttggcgcgcaaaaacgaaggctattggattaccattttccccgaaggcacacgccttgcgcccggaaaacgcggcaaatacaaactcggcggcgcgcgcatggcgaaaatgtttgagatggacatcgtccccgtcgccctcaacagcggcgaattttggccgaaaaactcctttctgaaatatccgggggaaatcaccgtcgtcatctgtccgaccatcccgcacgcaagcggcagcgaagccgaattgatgggaaaatgcgaacacctcatcgaaacgcagcagccgctcatttccggcgcaggcccgtttgccgccaaaatgccgtctgaaaccgcatga

SEQ ID NO: 1654 - protein, 247 aa, Neisseria meningitidis
MLIIRNLIYWLILCSTLIFLFPFMLLASPFRDGAHKMARVWVKILNLSLKHIVGLKYRIIGAENIPDRPAVICAKHQSGWETLALQDIFPPQVYVAKRELFKIPFFGWGLKLVKTIGIDRNNRREANEQLIKQGLARKNEGYWITIFPEGTRLAPGKRGKYKLGGARMAKMFEMDIVPVALNSGEFWPKNSFLKYPGEITVVICPTIPHASGSEAELMGKCEHLIETQQPLISGAGPFAAKMPSETA

SEQ ID NO: 1655 - DNA, 1773 bp, Neisseria meningitidis
atgatactgccagcccgtttttcagacggcatcagcctttccctgcgcctgaaactcctgaccggactgtgggtcgggttggcggcattgtctgtcgttttgacactgctgctctctttgcgtctggaaaacgcggcctccgtcatcgaagaggcgggcaacttgagaatgcaggcataccgtctggcatacatggcgggtgaaggctcgccccgtgcgcaaattgacaatcaggttgccgaatttgaaaaaagtttaaaacgcattgcccaaagcgatgccatccatccgctgattccttcggacacccctcttgcttatgatttgatacaatccatgctgattatagattggcaggcacacatcctccccccgctccagtcctaccggcgaccgactcaggtcgatctctaccgctttgccggaaacatcgaactgtttttgcaggcattggaaaatgccaacgaaaaaaacacatggtggctcaggcgttttcaatgggcaattatgttgatgacgctggtgtcgtctgtactgatgctgttttggcaccagatttgggttatccggccgctgcaggcgttaagggaaggtgcggaacgcatcggacggaggtgtttcgatattccggttcccgaaggcggtacgccggaattcaaacaggtcgggcgttgtttcaatcaaatgggcggcaggttgaaaattttatatgatgatttggaaggacaagtcgccgagcagacacgcagtctcgaaaaacaaaatcaaaacctgaccctgctgtaccaaactacacgggacctgcaccaatcctacataccgcaacaggctgcagaacattttctaaaccgtatcctgcccgccgtaggagcagattccggcagagtttgtttggacggcggatccgatgtttatgtttccattcatcatgcggattgcggcacagcagcttcggatttggggaagtaccatgaggaaatcttccccattgagtaccagaacgaaacattgggcaggctgttgctcagctttccaaacggcatttctcttgatgaagacgaccgcatcctgcttcaaacactaggcaggcaattgggcgtatcgcttgccggcgcaaaacaggaggaagaaaaacgcctgcttgcagtattgcaggaacgcaacctgattgcgcaaggattacatgacagcatcgcacaagcattaacgttcctaaacctacaggtacagatgctggaaaccgcctttgccgaaaacaaacgggaggaagccgcagaaaacatcagctttatcaaaacaggcgtgcaggaatgttatgaagatgtccgcgaactgctgctcaacttccgtaccaaaatcagcaataaagaatttcccgaagccgttgccgacctattcgcccgctttacgcaacaaaccgggataacggtcgaaaccgcctgggaaaacggttcgttcctgccgcctcaggaagcgcagctccaaatgatttttatcctgcaggaaagcctgtccaacatccgcaaacacgcccgcgccacccatgtaaaattcaccctttccgaacacggcggacgctttaccatgaccatccaagacaacggacaaggtttcgacacggagaaaataggagaacccacgggcagccatgtcggactgcacatcatgcaggagcgtgccaaacgcatccatgccgttttagaaatccgttcccaagctcaacagggaaccaccgtctcattgacggttgcatctgaagaaagcttgaaatga

SEQ ID NO: 1656 - protein, 590 aa, Neisseria meningitidis
MILPARFSDGISLSLRLKLLTGLWVGLAALSVVLTLLLSLRLENAASVIEEAGNLRMQAYRLAYMAGEGSPRAQIDNQVAEFEKSLKRIAQSDAIHPLIPSDTPLAYDLIQSMLIIDWQAHILPPLQSYRRPTQVDLYRFAGNIELFLQALENANEKNTWWLRRFQWAIMLMTLVSSVLMLFWHQIWVIRPLQALREGAERIGRRCFDIPVPEGGTPEFKQVGRCFNQMGGRLKILYDDLEGQVAEQTRSLEKQNQNLTLLYQTTRDLHQSYIPQQAAEHFLNRILPAVGADSGRVCLDGGSDVYVSIHHADCGTAASDLGKYHEEIFPIEYQNETLGRLLLSFPNGISLDEDDRILLQTLGRQLGVSLAGAKQEEEKRLLAVLQERNLIAQGLHDSIAQALTFLNLQVQMLETAFAENKREEAAENISFIKTGVQECYEDVRELLLNFRTKISNKEFPEAVADLFARFTQQTGITVETAWENGSFLPPQEAQLQMIFILQESLSNIRKHARATHVKFTLSEHGGRFTMTIQDNGQGFDTEKIGEPTGSHVGLHIMQERAKRIHAVLEIRSQAQQGTTVSLTVASEESLK

SEQ ID NO: 1657 - DNA, 1773 bp, Neisseria meningitidis
atgatactgccagcccgtttttcagacggcatcagcctttccctgcgcctgaaactcctgaccggactgtgggtcgggttggcggcattgtctgtcgttttgacactgctgctctctttgcgtctggaaaacgcggcctccgtcatcgaagaggcgggcaacttgagaatgcaggcataccgtctggcatacatggcgggtgaaggctcgccccgtgcgcaaattgacaatcaggttgccgaatttgaaaaaagtttaaaacgcattgcccaaagcgatgccatccatccgctgattccttcggacacccctcttgcttatgatttgatacaatccatgctgattatagattggcaggcacacatcctccccccgctccagtcctaccggcgaccgactcaggtcgatctctaccgctttgccggaaacatcgaactgtttttgcaggcattggaaaatgccaacgaaaaaaacacatggtggctcaggcgttttcaatgggcaattatgttgatgacgctggtgtcgtctgtactgatgctgttttggcaccagatttgggttatccggccgctgcaggcgttaagggaaggtgcggaacgcatcggacggaggtgtttcgatattccggttcccgaaggcggtacgccggaattcaaacaggtcgggcgttgtttcaatcaaatgggcggcaggttgaaaattttatatgatgatttggaaggacaagtcgccgagcagacacgcagtctcgaaaaacaaaatcaaaacctgaccctgctgtaccaaactacacgggatctgcaccaatcctacataccgcaacaggctgcagaacattttctaaaccgtatcctgcccgccgtaggagcagattccggcagagtttgtttggacggcggatccgatgtttatgtttccattcatcatgcggattgcggcacagcagcttcggatttggggaagtaccatgaggaaatcttccccattgagtaccagaacgaaacattgggcaggctgttgctcagctttccaaacggcatttctcttgatgaagacgaccgcatcctgcttcaaacactaggcaggcaattgggcgtatcgcttgccggcgcaaaacaggaggaagaaaaacgcctgcttgcagtattgcaggaacgcaacctgattgcgcaaggattacatgacagcatcgcacaagcattaacgttcctaaacctacaggtacagatgctggaaaccgcctttgccgaaaacaaacgggaggaagccgcagaaaacatcggcttcatcaaaacaggcgtgcaggaatgttatgaagatgtccgcgaactgctgctcaacttccgtaccaaaatcagtaataaagaatttcccgaagccgttgccgacctattctcgcgctttacgcaacagaccggcacgactgtcgaaaccgcttgggaaaacggcacgcacctgcctacacaggacgagcagctccaaatgattttcatcctgcaagaaagcttgtccaacatccgaaaacatgcccacgccacccatatcaaattcagactgctcaaacaggatggaagttttacaatgaccattcaagacaacggacagggttttgacacggaaaacattggagaaccatcgggcagccatgtcggactgcatatcatgcaggagcgtgccaaacgcatccatgccgttttagaaatccgttcccaagctcaacagggaaccaccgtctcattgacggttgcatctgaagaaagcttgaaatga

SEQ ID NO: 1658 - protein, 590 aa, Neisseria meningitidis
MILPARFSDGISLSLRLKLLTGLWVGLAALSVVLTLLLSLRLENAASVIEEAGNLRMQAYRLAYMAGEGSPRAQIDNQVAEFEKSLKRIAQSDAIHPLIPSDTPLAYDLIQSMLIIDWQAHILPPLQSYRRPTQVDLYRFAGNIELFLQALENANEKNTWWLRRFQWAIMLMTLVSSVLMLFWHQIWVIRPLQALREGAERIGRRCFDIPVPEGGTPEFKQVGRCFNQMGGRLKILYDDLEGQVAEQTRSLEKQNQNLTLLYQTTRDLHQSYIPQQAAEHFLNRILPAVGADSGRVCLDGGSDVYVSIHHADCGTAASDLGKYHEEIFPIEYQNETLGRLLLSFPNGISLDEDDRILLQTLGRQLGVSLAGAKQEEEKRLLAVLQERNLIAQGLHDSIAQALTFLNLQVQMLETAFAENKREEAAENIGFIKTGVQECYEDVRELLLNFRTKISNKEFPEAVADLFSRFTQQTGTTVETAWENGTHLPTQDEQLQMIFILQESLSNIRKHAHATHIKFRLLKQDGSFTMTIQDNGQGFDTENIGEPSGSHVGLHIMQERAKRIHAVLEIRSQAQQGTTVSLTVASEESLK

SEQ ID NO: 1659 - DNA, 627 bp, Neisseria gonorrhoeae
atggcaagcccgtcgagtctgcctttcaattcgggcaagaccaaaccgacggcttttgccgcgccggttttggtcggaatcatgttttccacgccgctgcgggcgcggcgcaggtctttgtggcgcacgtcggtaacggtttggtcgttggtcagtgcgtggatggtggtcattgcgcctttgacgatgccgacgctttcgctcaacactttggcaaccggcgagaggcagttggtggtgcaggaagcgttggaaacgacggtcatgtcggcggtcaggacgctgtcgttcacgccgtacacgacggttgcatcgacatcgtcgccgcccggtgcggaaatgaggacttttttcgcgccgctttcgaggtggattttggctttttctttgctggtgaacgcgccggtgcattccatgaccaaatcgacaccgagttctttccacggcagttcggcagggttgcgggtcgagaagaaggggattttgtcgccgttgacgatgaggttgccgccgtcgtgggatacgtcggcttcaaagcgtccgtgtacggtgtcgaatttggtcagatgggcgttggtttcaaggctgccgctggcgttgacggcgacgatttggagttggtcttga

SEQ ID NO: 1660 - protein, 208 aa, Neisseria gonorrhoeae
MASPSSLPFNSGKTKPTAFAAPVLVGIMFSTPLRARRRSLWRTSVTVWSLVSAWMVVIAPLTMPTLSLNTLATGERQLVVQEALETTVMSAVRTLSFTPYTTVASTSSPPGAEMRTFFAPLSRWILAFSLLVNAPVHSMTKSTPSSFHGSSAGLRVEKKGILSPLTMRLPPSWDTSASKRPCTVSNLVRWALVSRLPLALTATIWSWS

SEQ ID NO: 1661 - DNA, 627 bp, Neisseria meningitidis
atggcaagcccgtcgagcctgcctttcaattcgggcagtaccaaaccgacggcttttgccgcgccggttttggtcggaatcatgttttccacgccgctgcgggcgcggcgcaggtctttgtggcgcacgtcggtaacggtttggtcgttggtcagcgcgtggatggtggtcatcgcgcctttgacgatgccgacgctttcgctcaacactttggcaaccggcgagaggcagttggtggtgcaggaagcgttggaaacgacggtcatgtcggcggtcaggacgctgtcgttcacgccgtacacgacggttgcatcgacatcgtcgccgcccggtgcggaaatgaggacttttttcgcgccgctttcgaggtggattttggctttttctttgctggtgaacgcgccggtgcattccatgaccaaatcgacaccgagttctttccacggcagttcggcagggttgcgggtcgagaagaaggggattttgtcgccgttgacgatgaggttgccgccgtcgtgggatacgtcggcttcaaagcgtccgtgcacggtgtcgaatttggtcagatgggcgttggtttcaaggctgccgctggcgttgacggcgacgagttggagttggtcttga

SEQ ID NO: 1662 - protein, 208 aa, Neisseria meningitidis
MASPSSLPFNSGSTKPTAFAAPVLVGIMFSTPLRARRRSLWRTSVTVWSLVSAWMVVIAPLTMPTLSLNTLATGERQLVVQEALETTVMSAVRTLSFTPYTTVASTSSPPGAEMRTFFAPLSRWILAFSLLVNAPVHSMTKSTPSSFHGSSAGLRVEKKGILSPLTMRLPPSWDTSASKRPCTVSNLVRWALVSRLPLALTATSWSWS

SEQ ID NO: 1663 - DNA, 627 bp, Neisseria meningitidis
  misc_feature (469)..(469): n is a, c, g, or t
  misc_feature (477)..(477): n is a, c, g, or t
atggcaagcccgtcgagtttgtctttcaattcgggcagtaccaaaccgacggcttttgccgcgccagttttggtcggaatcatgttttccacgccgctgcgggcgcggcgcaggtctttgtggcgcacgtcggtaacggtttggtcgttggtcagcgcgtggatggtggtcatcgcgcctttgacgatgccgacgctttcgctcaacactttggcaaccggcgagaggcagttggtggtgcaggaagcgttggaaacgacggtcatgtcggcggtcaggatgctgtcgttcacgccgtacacgacggttgcatcgacatcgtcgccgcccggtgcggaaatgaggacttttttcgcgccgctttccagatgaactttggctttttctttgctggtgaacgcgccggtgcattccatgaccaaatcgacaccgagttctttccacggcagttcggcagggttgcgggtcnagaagaangggattttgtcgccgttgacgatgaggttgccgccgtcgtgggatacgtcggcttcaaagcgtccgtgcacggtgtcgaatttggtgaggtgggcgttggtttcaaggctgccgctggcgttgacggcgacgatttggagttggtcttga

SEQ ID NO: 1664 - protein, 207 aa, Neisseria meningitidis
  misc_feature (156)..(156): Xaa can be any naturally occurring amino acid
  misc_feature (158)..(158): Xaa can be any naturally occurring amino acid
MASPSSLSFNSGSTKPTAFAAPVLVGIMFSTPLRARRRSLWRTSVTVWSLVSAWMVVIAPLTMPTLSLNTLATGERQLVVQEALETTVMSAVRMLSFTPYTTVASTSSPPGAEMRTFFAPLSRTLAFSLLVNAPVHSMTKSTPSSFHGSSAGLRVXKXGILSPLTMRLPPSWDTSASKRPCTVSNLVRWALVSRLPLALTATIWSWS

SEQ ID NO: 1665 - DNA, 6147 bp, Neisseria gonorrhoeae
atgaacaaaaccctctatcgtgtgattttcaaccgcaaacgcggtgctgtggtagctgttgccgaaaccaccaagcgcgaaggtaaaagctgtgccgatagtggttcgggcagcgtttatgtgaaatccgtttctttcattcctactcattccaaagccttttgtttttctgcattaggcttttctttatgtttggctttgggtacggtcaatattgcttttgctgacggcattattactgataaagctgctcctaaaacccaacaagccacgattctgcaaacaggtaacggcataccgcaagtcaatattcaaacccctacttcggcaggggtttctgttaatcaatatgcccagtttgatgtgggtaatcgcggggcgattttaaacaacagtcgcagcaacacccaaacacagctaggcggttggattcaaggcaatccttggttgacaaggggcgaagcacgtgtggttgtaaaccaaatcaacagcagccatccttcacaactgaatggctatattgaagtgggtggacgacgtgcagaagtcgttattgccaatccggcagggattgcagtcaatggtggtggttttatcaatgcttcccgtgccactttgacgacaggccaaccgcaatatcaagcaggagactttagcggctttaagataaggcaaggcaatgctgtaatcgccggacacggtttggatgcccgtgataccgatttcacacgtattcttttgtatgccaacaaaatcaccttgatcagtacggccgaacaagcaggcattcgtaatcaagggcagttgtttgcttcttccggtaatgtggcgattgatgcaaatggccgtttggtcaatagtggcacgatggctgccgccaatgtgcaagatatgaataatacagcggaacacaaagtcaatatccgcagtcaagcctttgaaaacagcggtacggcggtatcgcaacaaggcactcaaattcacagtcaatcgattcaaaacactggcaaattattgtcggcaggaacagaggatttagccgtttcaggcagcctgaacaatcaaaatggcgaaatagcgaccaatcaacaactgattattcacgatggtcagcaatctaccgttgtcattgataatacgaatggcacgatacaatcaggccgtgatgttgccattcaggcaaaatcgttatccaacaacggcacacttgccgctgataataaactggatattgcgttacaagatgatttttatgtagaacgcaagatcgtggcgggcaatgaattgtcgctcagtacacgaggcagcctgaaaaattcacataccttgcaagcaggaaaacgcattcggattaaagcaaataaccttgataatgcagtacaaggcaacattcaatccggcggtacgacagacattggcacgcagcacaatttaaccaatagaggcttgattgacggacaacaaaccaaaatccaagccgggcaaatgaataatatcggtacaggtcggatttatggcgacaatatcgctattgcggctacccgcttagacaatcaagatgaaaacggtacaggtgccgccattgcggcacgcgaaaacctgaatttaggcattgaacaattaaataaccgtgaaaacagtctgatttacagcggtaacgatatggcggttggcggcgcattagataccaatgaccaagccacaggcaaagcccaaaggatacacaatgccggcgcaatcattgaagctgcaggcaaaatgcgtttaggtgtagaaaagctgcacaataccaatgagcatttgaaaacgcagttggtagaaacagggcgcgagcgtattgttgattacgaagcatttggacgacacgaattattgcgagaaggcacgcaacatgaattaggctggtttgtctacaacaatgaatcagaccacttacgcacccctgatggagtggcgcatgaaaattggcataaatacgattatgaaaaagtaacgcaagaaactcaagtaaccggaactgcgcctgctaaaatcattgcaggtagcgatttgattattgatagcaaagcagtcttcaacagcgacagccgaatcattgccggcggccaattgcttgtgcaaacagaaaaagacggtttgcataacgagcaaacctttggcgagaagaaagtcttcagcgaaaatggtaagttgcacaactactggcgtgcgcgtcgtaaaggacatgatgaaacagggcatcgtgaacaaaattatactttgccggaggaaatcacacgcgacatttcactgggttcatttgcctatgaatcgcatagcaaagcattaagccgtcatgcgcccagccaaggcactgagttgccacaaagtaaccgggataatatccgtactgcgaaaagcaacggtatttcgctaccctatacgcccaattcttttaccccattacccggcagcagcttatacattatcaatcctgccaataaaggctatcttgttgaaaccgatccacgctttgccaactaccgtcaatggttgggtagtgactatatgctgggcagcctcaaactagacccaaacaatttacataaacgtttgggtgatggttattacgagcaacgtttaatcaatgaacaaatcgcagagctgacagggcatcgtcgtttagacggttatcaaaacgacgaagaacaatttaaagccttaatggataatggcgcgactgcggcacgttcgatgaatctcagcgttggcattgcattaagtgccgagcaagcagcgcaactgaccagcgatattgtttggttggtacaaaaagaagttaaacttcctgatggcggcacacaaaccgtattgatgccacaggtttatgtacgcgttaaaaatggcggcatagacggtaaaggtgcattgttgtcaggcagcaatacacaaatcaatgtttcaggcagcctgaaaaactcaggcacgattgcagggcgcaatgcgcttattatcaataccgatacgctagacaatatcggtgggcgtattcatgcgcaaaaatcagcggttacggccacacaagacatcaataatattggcggcattctttctgccgaacagacattattgctcaatgcgggtaacaacatcaacaaccaaagcacggccaagagcagtcaaaatgcacaaggtagcagcacctacctagaccgaatggcaggtatttatatcacaggcaaagaaaaaggtgttttagcagcgcaggcaggcaaagacatcaacatcattgccggtcaaatcagcaatcaatcagatcaagggcaaacccggctgcaggcaggacgcgacattaacctggatacggtacaaaccggcaaatatcaagaaatccattttgatgccgataaccataccatccgaggttcaacgaacgaagtcggcagcagcattcaaacaaaaggcgatgttaccctattgtcagggaataatctcaatgccaaagctgccgaagtcggcagcgcaaaaggcacacttgccgtgtatgctaaaaatgacattactatcagctcaggcatccatgccggccaagttgatgatgcgtccaaacatacaggcagaagcggcggcggtaataaattagtcattaccgataaagcccaaagtcatcacgaaactgctcaaagcagcacctttgaaggcaagcaagttgtattgcaggcaggaaacgatgccaacatccttggcagtaatgttatttccgataatggcacccggattcaagcaggcaatcatgttcgcattggtacaacccaaactcaaagccaaagcgaaacctatcatcaaacccaaaaatcaggattgatgagtgcaggtatcggcttcactattggcagcaagacaaacacacaagaaaaccaatcccaaagcaacgaacatacaggcagtaccgtaggcagcctgaaaggcgataccaccattgttgcaagcaaacactacgaacaaaccggcagcaacgtttccagccctgagggcaacaaccttatcagcacgcaaagtatggatattggcgcagcacaaaaccaattaaacagcaaaaccacccaaacctacgaacaaaaaggcttaacggtgggcattcagttcgcccgttaccgatttggcacaacaagcgattgccgtagcacacaaagcagcaaacaagtcggacaaagcaaaaacgaccgcgttaatgccatggcggctgccaatgcaggttggcaggcctatcaaacaggcaaaggcgcacaaaacttagccaatggtacaaccaatgccaaacaagtcagcatctccataacctacggcgaacagcaaaaccgacaaaccacccaagttcaagccaatcaagcccaagcgagtcaaattcaagcaggcggcaaaactaccctttattgccgaaggtgcggcgaacaatccaatatcaacatcacaggctcaggtgtttcaggcagagcaggaaccggcctgattgccgataagcaaatccatctgcaatcagccgagcaaagcaataccgaacgcagccaaaacaaatcagcaggctggaacgcaggtgctgccgtatcattcggacaaggaggctggtcattaggcgttgccgcaggcggcaatgtcggcaaaggctacggctatggcgatagcgtaacccaccgccatagccatattggcgacaaaggcagccaaacccttatccaaagtggtggcgataccatcatcaaaggcgcgcaagtacgcggcaaaggcgtacaagtcaatgccaaaaacctaagcattcaaagtgtacaagatagagaaacttatcaaagcaaacaacaaaacgccggtgcacaagttaccgtaggttatggcttcagtgccagtggcgattacagccaaagcaaaatccgagccgaccatgcttcggtaaccgagcaaagcggtatttatgccggagaagacggctatcaaatcaaggtcggaaaccatacaggcctcaaaggcggcatcatcaccagcagccaaagcgcaaaagacaagggtaaaaaccgattcagcacaggcacactcgccggcagtgatattcaaaattacagccaatacgaaggaaaaagttttggattgggtgccagcgttgccgtaagcggcaaaacactgggacagggcgcaaaaaataaacctcaagacaaacacctgacaagcatagccgataaaaacggcgcaagttcatcagtagggtacggcagcgacagcgacagtcaaagcagcatcacaaaaagcggcatcaatacccccaaaaacattcaaatcacagacgaagccgcacaaatcaggctgacaggcaaaatagcggcacaaaccaaagccgatattgatacaaacgtaaccacagacaccgccgaacgacattcgggcagcctgaaaaacatatttgacaaagatagagtgcaaagtgaactggatttacaaagaaccgtcagccaagattttagtaaaaatgttcaacaaaccaataccgagattaaccaacatttagacaaactcaaagcagacaaagaagcagccgaaacagcagcagccgaggcattagccaatggcgatatggaaactgccaaacgcaaagcccatgaagctcaagatgcggcagcaaaagcagataattggcaacaaggcaaagtcattctcaacatgttagcctcaggtttagctgagccgacccaaagcggagcgggcatcgctgcggctaccgcatcgccagacgtatcgtatgcgattggacagcactttaaagatttagccggtcaaaacgcgaatggcaaactaaccgccagtcaagaaaccgctcacgttcttgcccacgcggtattaggagcagcggttgccgcagcatgaggcaacaatgccccggcaggagcattgggtgcgggcgggtcggaagcggccgccccaatcatcggcaaatggctgtacggcaaaggagacggcggcagcctgaatgcggaggaaaaagagaccgtttcggcgattacaaggatgctgggtacggctgccggagcagctgagggaaactcgtccgccgatgctgtgtggggttgttttcaaacggcttcagatttcgcttcctctttttcatatcctataaacatgtga

SEQ ID NO: 1666 - protein, 2048 aa, Neisseria gonorrhoeae
  misc_feature (1963)..(1963): Xaa can be any naturally occurring amino acid
MNKTLYRVIFNRKRGAVVAVAETTKREGKSCADSGSGSVYVKSVSFIPTHSKAFCFSALGFSLCLALGTVNIAFADGIITDKAAPKTQQATILQTGNGIPQVNIQTPTSAGVSVNQYAQFDVGNRGAILNNSRSNTQTQLGGWIQGNPWLTRGEARVVVNQINSSHPSQLNGYIEVGGRRAEVVIANPAGIAVNGGGFINASRATLTTGQPQYQAGDFSGFKIRQGNAVIAGHGLDARDTDFTRILLYANKITLISTAEQAGIRNQGQLFASSGNVAIDANGRLVNSGTMAAANVQDMNNTAEHKVNIRSQAFENSGTAVSQQGTQIHSQSIQNTGKLLSAGTEDLAVSGSLNNQNGEIATNQQLIIHDGQQSTVVIDNTNGTIQSGRDVAIQAKSLSNNGTLAADNKLDIALQDDFYVERKIVAGNELSLSTRGSLKNSHTLQAGKRIRIKANNLDNAVQGNIQSGGTTDIGTQHNLTNRGLIDGQQTKIQAGQMNNIGTGRIYGDNIAIAATRLDNQDENGTGAAIAARENLNLGIEQLNNRENSLIYSGNDMAVGGALDTNDQATGKAQRIHNAGAIIEAAGKMRLGVEKLHNTNEHLKTQLVETGRERIVDYEAFGRHELLREGTQHELGWFVYNNESDHLRTPDGVAHENWHKYDYEKVTQETQVTGTAPAKIIAGSDLIIDSKAVFNSDSRIIAGGQLLVQTEKDGLHNEQTFGEKKVFSENGKLHNYWRARRKGHDETGHREQNYTLPEEITRDISLGSFAYESHSKALSRHAPSQGTELPQSNRDNIRTAKSNGISLPYTPNSFTPLPGSSLYIINPANKGYLVETDPRFANYRQWLGSDYMLGSLKLDPNNLHKRLGDGYYEQRLINEQIAELTGHRRLDGYQNDEEQFKALMDNGATAARSMNLSVGIALSAEQAAQLTSDIVWLVQKEVKLPDGGTQTVLMPQVYVRVKNGGIDGKGALLSGSNTQINVSGSLKNSGTIAGRNALIINTDTLDNIGGRIHAQKSAVTATQDINNIGGILSAEQTLLLNAGNNINNQSTAKSSQNAQGSSTYLDRMAGIYITGKEKGVLAAQAGKDINIIAGQISNQSDQGQTRLQAGRDINLDTVQTGKYQEIHFDADNHTIRGSTNEVGSSIQTKGDVTLLSGNNLNAKAAEVGSAKGTLAVYAKNDITISSGIHAGQVDDASKHTGRSGGGNKLVITDKAQSHHETAQSSTFEGKQVVLQAGNDANILGSNVISDNGTRIQAGNHVRIGTTQTQSQSETYHQTQKSGLMSAGIGFTIGSKTNTQENQSQSNEHTGSTVGSLKGDTTIVASKHYEQTGSNVSSPEGNNLISTQSMDIGAAQNQLNSKTTQTYEQKGLTVGIQFARYRFGTTSDCRSTQSSKQVGQSKNDRVNAMAAANAGWQAYQTGKGAQNLANGTTNAKQVSISITYGEQQNRQTTQVQANQAQASQIQAGGKTTLYCRRCGEQSNINITGSGVSGRAGTGLIADKQIHLQSAEQSNTERSQNKSAGWNAGAAVSFGQGGWSLGVAAGGNVGKGYGYGDSVTHRHSHIGDKGSQTLIQSGGDTIIKGAQVRGKGVQVNAKNLSIQSVQDRETYQSKQQNAGAQVTVGYGFSASGDYSQSKIRADHASVTEQSGIYAGEDGYQIKVGNHTGLKGGIITSSQSAKDKGKNRFSTGTLAGSDIQNYSQYEGKSFGLGASVAVSGKTLGQGAKNKPQDKHLTSIADKNGASSSVGYGSDSDSQSSITKSGINTPKNIQITDEAAQIRLTGKIAAQTKADIDTNVTTDTAERHSGSLKNIFDKDRVQSELDLQRTVSQDFSKNVQQTNTEINQHLDKLKADKEAAETAAAEALANGDMETAKRKAHEAQDAAAKADNWQQGKVILNMLASGLAEPTQSGAGIAAATASPDVSYAIGQHFKDLAGQNANGKLTASQETAHVLAHAVLGAAVAAAXGNNAPAGALGAGGSEAAAPIIGKWLYGKGDGGSLNAEEKETVSAITRMLGTAAGAAEGNSSADAVWGCFQTASDFASSFSYPINM

SEQ ID NO: 1667 - DNA, 7545 bp, Neisseria meningitidis
atgaataaaactctctatcgtgtaattttcaaccgcaaacgtggggctgtggtagccgttgctgaaactaccaagcgcgaaggtaaaagctgtgccgatagtgattcaggcagcgctcatgtgaaatctgttccttttggtactactcatgcacctgtttgtcgttcaaatatcttttctttttctttattgggcttttctttatgtttggctgtaggtacggccaatattgcttttgctgatggcattattgctgataaagctgctcctaaaactcaacaagccacgattctgcaaacaggtaacggcataccgcaagtcaatattcaaacccctacttcggcaggggtttctgttaatcaatacgcccagtttgatgtgggtaatcgcggggcgattttaaacaacagccgcagcaacacccaaacacagctaggcggttggattcaaggtaatccttggttggcaaggggcgaagcacgtgtggttgtaaaccaaatcaacagcagccattcttcacaaatgaatggctatattgaagtgggcggacgacgtgcagaagtcgttattgccaatccggcagggattgcagtcaatggtggtggttttatcaatgcttcccgtgccactttgacgacaggccaaccgcaatatcaagcaggagaccttagcggctttaagataaggcaaggcaatgttgtaatcgccggacacggtttggatgcccgtgataccgatttcacacgtattctcagttatcattccaaaattgatgcacccgtatggggacaagatgttcgtgtcgtcgcgggacaaaacgatgtggtcgcaacaggtaatgcacattcgcctattctcaataatgctgctgccaatacgtcaaacaatacagccaacaacggcacacatatccctttatttgcgattgatacaggcaaattaggaggtatgtatgccaacaaaatcaccttgatcagtacggccgagcaagcaggcattcgtaatcaagggcagttgtttgcttcttccggtaatgtggcgattgatgcaaatggccgtttagtcaatagtggcacgatggctgccgccaatgcgaaagatacggataatacagcggaacacaaagtcaatatccgcagtcagggcgttgaaaacagcggtacggcggtatcgcaacaaggcactcaaattcacagtcagtcgattcaaaacactggcacattattgtcctcaggcgaaatattgattcacaattcgggcagcctgaaaaatgaaacatcaggcaccattgaagccgctcgtttggctattgataccgacacacttaataatcaaggcaaactctctcaaacaggttcacaaaaactccatattgatgcacaaggcaaaatggataaccgtggccgcatgggtttacaagataccgcaccaaccgcgtcaaatggttcaagcaatcaaaccggcaatagttacaatgcatctttccattcatccactaccacaccaacaacggcaacaggtacgggtactgcaaccgtttctatatcaaacataactgcgcctacctttgctgatgggacaattcgcactcatggtgcactggataattcaggcagtattattgccaatggtcaaacagatgttagtgcgcaacaaggtttaaataatgcaggacaaatagacattcatcagttaaatgcaaaaggttcggcgtttgacaatcacaatggaacaattatcagtgatgcggtccacattcaagccggcagcctgaataatcaaaatggcaacatcacaacacgccaacagttagagattgaaaccgatcaactggataacgctcatggcaagttattatcagcagaaatagcggatttagccgtttcaggcagcctgaacaatcaaaatggcgaaatagcgaccaatcaacaactgattattcacgatggtcagcaatctaccgctgtcattgataatacgaatggcacgatacaatcaggccgtgatgttgctattcaggcaaaatcgttatccaacaacggcacacttgccgctgataataaactggatattgcgttacaagatgatttttatgtagaacgcaatatcgtggcgggcaatgaattgtcgctcagtacacgaggcagcctgaaaaattcacatactttgcaagcaggaaaacgcattcggattaaagcaaataaccttgataatgcagcacaaggcaacattcaatccggcggtacgacagacattggcacgcagcacaatttaaccaatagaggcttgattgacggacaacaaaccaaaatccaagccgggcaaatgaataatatcggtacaggtcggatttatggcgacaatatcgctattgcggctacccgcttagacaatcaagatgaaaacggtacaggtgccgccattgcggcacgtgaaaacctgaatttaggcatcggacaattaaacaaccgtgaaaacagtctgatttacagcggtaacgatatggcggttggcggcgcattagataccaatggccaagccacaggcaaagcccaaaggatacacaatgccggcgcaaccattgaagctgcaggcaaaatgcgtttaggtgtagaaaagctgcacaataccaatgagcatttgaaaacgcagttggtagaaacagggcgcgagcatattgttgattacgaagcatttggacgacacgaattattgcgagaaggcacgcaacatgaattaggctggtctgtctataacgatgaatcagaccacttacgcacccctgatggagcggcgcatgaaaattggcataaatacgattatgaaaaagtcacccaaaaaacccaagttacccaaactgcgccagccaaaatcatttcaggtaatgatttaaccattgatggtaaagaagtatttaataccgatagccaaatcattgctggtggcaatctcattgtacaaacagaaaaagacggtttgcataacgagcaaacctttggcgaaaagaaagtattcagtgaaaatggcaaattacacagctattggcgtgagaaacataaaggacgagactcaacgggacatagcgaacaaaattacactttgccggaggaaatcacacgcaacatttcactgggttcatttgcctatgaatcgcatcgcaaagcattaagccatcatgcgcccagccaaggcactgagttgccgcaaagcaacggtatttcgctaccctatacgtccaattcttttaccccattacccagcagcagcttatacattatcaatcctgtcaataaaggctatcttgttgaaaccgatccacgctttgccaactaccgtcaatggttgggtagtgactatatgctggacagcctcaaactagacccaaacaatttacataaacgtttgggtgatggttattacgagcaacgtttaatcaatgaacaaatcgcagagctgacagggcatcgtcgtttagacggttatcaaaacgacgaagaacaatttaaagccttaatggataatggcgcgactgcggcacgttcgatgaatctcagcgttggcattgcattaagtgccgagcaagtagcgcaactgaccagcgatattgtttggttggtacaaaaagaagttaagcttcctgatggcggcacacaaaccgtattggtgccacaggtttatgtacgcgttaaaaatggcgacatagacggtaaaggtgcattgttgtcaggcagcaatacacaaatcaatgtttcaggcagcctgaaaaactcaggcacgattgcagggcgcaatgcgcttattatcaataccgatacgctagacaatatcggtgggcgtattcatgcgcaaaaatcagcggttacggccacacaagacatcaataatattggcggcatgctttctgccgaacagacattattgctcaacgcaggcaacaacatcaacagccaaagcaccaccgccagcagtcaaaatacacaaggcagcagcacctacctagaccgaatggcaggtatttatatcacaggcaaagaaaaaggtgttttagcagcgcaggcaggaaaagacatcaacatcattgccggtcaaatcagcaatcaatcagagcaagggcaaacccggctgcaagcagggcgcgacattaacctagatacggtacaaaccagcaaacatcaagcaacccattttgatgccgataaccatgttattcgcggttcaacgaacgaagtcggcagcagcattcaaacaaaaggcgatgttaccctattgtcagggaataacctcaatgccaaagctgccgaagtcagcagcgcaaacggtacactcgctgtgtctgccaaaaatgacatcaacatcagcgcaggcatcaacacgacccatgttgatgatgcgtccaaacacacaggcagaagcggtggtggcaataaattagtcattaccgataaagcccaaagtcatcacgaaaccgcccaaagcagcacctttgaaggcaagcaagttgtattgcaggcaggaaacgatgccaacatccttggcagcaatgttatttccgataatggcacccagattcaagcaggcaatcatgttcgcattggtacaacccaaactcaaagccaaagcgaaacctatcatcaaacccagaaatcaggattgatgagtgcaggtatcggcttcactattggcagcaagacaaacacacaagaaaaccaatcccaaagcaacgaacatacaggcagtaccgtaggcagcttgaaaggcgataccaccattgttgcaggcaaacactacgaacaaatcggcagtaccgtttccagcccggaaggcaacaataccatctatgcccaaagcatagacattcaagcggcacacaacaaattaaacagtaataccacccaaacctatgaacaaaaaggcctaacggtggcattcagttcgcccgttaccgatttggcacaacaagcgattgccgtagcacaaagcagcaaacaagtcggacaaagcaaaaacgaccgcgttaatgccatggcggctgccaatgcaggctggcaagcctatcaaacaggtaagagtgcacaaaacttagccaatggtacaaccaatgccaaacaagtcagcatctccataacctacggcgaacagcaaaaccgacaaaccacccaagttcaagccaatcaagcccaagcgagtcaaattcaagcaggtggtaaaaccacattaatcgccacaggcgcagcagaacaatccaatatcaacatcgcaggctcagatgttgccggcaaagcaggcacaatcctgattgccgataacgacatcacactccaatcagccgagcaaagcaataccgaacgcggccaaaacaaatcggcaggctggaacgcaggtgctgccgtatcattcggacaaggaggctggtcattaggcgttaccgcaggcggcaatgtcggcaaaggctacggcaatggcgacagcatcacccaccgccatagccatatcggcgacaaaggcagccaaacccttatccaaagcggtggcgacactaccatcaaaggcgcgcaagtacgcggcaaaggcgtacaagtcaatgccaaaaacctaagtattcaaagcgtacaagatagagaaacctatcaaagcaaacaacaaaacgccagtgcacaagttaccgtaggttatggcttcagtgccggtggcgattacagccaaagcaaaatccgagccgaccatgtttcagtaaccgagcaaagcggtatttatgccggagaagacggctatcaaatcaaggtcggaaaccatacagacctcaaaggcggcatcatcaccagtacccaaagcgcagaagacaagggtaaaaaccgctttcagacggccaccctcacccatagcgacatcaaaaaccacagccaatacaaaggcgaaagttttggattgggcgcaagtgcgtccataagcggcaaaacactgggacagggcgcacaaaataaacctcaaaacaaacacctgacaagcgtagccgataaaaacagcgcaagttcatcagtgggttatggcagcgacagcgacagtcaaagcagcatcacaaaaagcggcatcaacacccgcaacattcaaatcaccgacgaagccgcacaaatccggctgacaggcaaaacagcggcacaaaccaaagccgatattgatacaaacgtaaccacagacaccgccgaacgacattcgggcagcttgaagaacaccttcaacaaagaagcggtgcaaagtgaactggatttacaaagaaccgtcagccaagattttagtaaaaatgttcaacaagccaataccgagattaaccaacatttagacaaactcaaagcagacaaagaagcagccgaaacagcagcagccgaggcattagccaatggcgatatggaaactgccaaacgcaaagcccatgaagctcaagatgcggcagcaaaagcagataattggcaacaaggcaaagtcattctcaacatgttagcctcaggtttagctgcgccgacccaaagcggagcgggcatcgctgcggctaccgcatcgccagccgtatcgtatgcgattggacagcactttaaagatttagccggtcaaaacgcgaatggtaaactaaccgccagtcaagaaaccgcacacgttcttgcccacgcggtattaggagcagcggttgccgcagtaggagacaacaatgctctagcaggagcattgagtgcgggcgggtcggaagcggctgcgccttacatcagcaaatggttatacggcaaagaaaaaggaagcgacttaacggcggaagagaaagagactgtaacagcgattacaaatgtattgggtacggctacgggtgcggcagtcggcaacagcgcaacagatgcagcgcaaggcagcctgaatgcgcaaagtgcggtggagaataatgatactgtagagcaagtgaaatttgctcttaggcaccctagaattgctattgcaattggatctgtacataaagatcctggctctacattagagcctaatatttcaacaattgcttcaacttttcaattaaatttatttcctaatagtgaatttggtggtgaaggtggagttggcaatgcattcaggcacgttttatggcaagcaaccatcacacgagaatttggcaaagatattgctgttaaagtaggaaatagtcatgaaagtggggaaaaaattaattattctataagacgtaatctttcattagataaagcagatgaaatgattgatcaactaaataacgaaataggaagagaaatagcattaaataccaataggttaaacacaaaagagttagttggattaattctggaaacttataaaaataatggtttttatcaagcagaaagaaacagtaatggaaattatgatgttgtaagaaaaagattatctgaaaaagattaccagaatacaagcaatatattgattcacttagataatactggtgccggatttaaaattcagcagaggagaaaacaaatcagagcacaaatttcagccagacaatggagaagataa

SEQ ID NO: 1668 - protein, 2514 aa, Neisseria meningitidis
MNKTLYRVIFNRKRGAVVAVAETTKREGKSCADSDSGSAHVKSVPFGTTHAPVCRSNIFSFSLLGFSLCLAVGTANIAFADGIIADKAAPKTQQATILQTGNGIPQVNIQTPTSAGVSVNQYAQFDVGNRGAILNNSRSNTQTQLGGWIQGNPWLARGEARVVVNQINSSHSSQMNGYIEVGGRRAEVVIANPAGIAVNGGGFINASRATLTTGQPQYQAGDLSGFKIRQGNVVIAGHGLDARDTDFTRILSYHSKIDAPVWGQDVRVVAGQNDVVATGNAHSPILNNAAANTSNNTANNGTHIPLFAIDTGKLGGMYANKITLISTAEQAGIRNQGQLFASSGNVAIDANGRLVNSGTMAAANAKDTDNTAEHKVNIRSQGVENSGTAVSQQGTQIHSQSIQNTGTLLSSGEILIHNSGSLKNETSGTIEAARLAIDTDTLNNQGKLSQTGSQKLHIDAQGKMDNRGRMGLQDTAPTASNGSSNQTGNSYNASFHSSTTTPTTATGTGTATVSISNITAPTFADGTIRTHGALDNSGSIIANGQTDVSAQQGLNNAGQIDIHQLNAKGSAFDNHNGTIISDAVHIQAGSLNNQNGNITTRQQLEIETDQLDNAHGKLLSAEIADLAVSGSLNNQNGEIATNQQLIIHDGQQSTAVIDNTNGTIQSGRDVAIQAKSLSNNGTLAADNKLDIALQDDFYVERNIVAGNELSLSTRGSLKNSHTLQAGKRIRIKANNLDNAAQGNIQSGGTTDIGTQHNLTNRGLIDGQQTKIQAGQMNNIGTGRIYGDNIAIAATRLDNQDENGTGAAIAARENLNLGIGQLNNRENSLIYSGNDMAVGGALDTNGQATGKAQRIHNAGATIEAAGKMRLGVEKLHNTNEHLKTQLVETGREHIVDYEAFGRHELLREGTQHELGWSVYNDESDHLRTPDGAAHENWHKYDYEKVTQKTQVTQTAPAKIISGNDLTIDGKEVFNTDSQIIAGGNLIVQTEKDGLHNEQTFGEKKVFSENGKLHSYWREKHKGRDSTGHSEQNYTLPEEITRNISLGSFAYESHRKALSHHAPSQGTELPQSNGISLPYTSNSFTPLPSSSLYIINPVNKGYLVETDPRFANYRQWLGSDYMLDSLKLDPNNLHKRLGDGYYEQRLINEQIAELTGHRRLDGYQNDEEQFKALMDNGATAARSMNLSVGIALSAEQVAQLTSDIVWLVQKEVKLPDGGTQTVLVPQVYVRVKNGDIDGKGALLSGSNTQINVSGSLKNSGTIAGRNALIINTDTLDNIGGRIHAQKSAVTATQDINNIGGMLSAEQTLLLNAGNNINSQSTTASSQNTQGSSTYLDRMAGIYITGKEKGVLAAQAGKDINIIAGQISNQSEQGQTRLQAGRDINLDTVQTSKHQATHFDADNHVIRGSTNEVGSSIQTKGDVTLLSGNNLNAKAAEVSSANGTLAVSAKNDINISAGINTTHVDDASKHTGRSGGGNKLVITDKAQSHHETAQSSTFEGKQVVLQAGNDANILGSNVISDNGTQIQAGNHVRIGTTQTQSQSETYHQTQKSGLMSAGIGFTIGSKTNTQENQSQSNEHTGSTVGSLKGDTTIVAGKHYEQIGSTVSSPEGNNTIYAQSIDIQAAHNKLNSNTTQTYEQKGLTVAFSSPVTDLAQQAIAVAQSSKQVGQSKNDRVNAMAAANAGWQAYQTGKSAQNLANGTTNAKQVSISITYGEQQNRQTTQVQANQAQASQIQAGGKTTLIATGAAEQSNINIAGSDVAGKAGTILIADNDITLQSAEQSNTERGQNKSAGWNAGAAVSFGQGGWSLGVTAGGNVGKGYGNGDSITHRHSHIGDKGSQTLIQSGGDTTIKGAQVRGKGVQVNAKNLSIQSVQDRETYQSKQQNASAQVTVGYGFSAGGDYSQSKIRADHVSVTEQSGIYAGEDGYQIKVGNHTDLKGGIITSTQSAEDKGKNRFQTATLTHSDIKNHSQYKGESFGLGASASISGKTLGQGAQNKPQNKHLTSVADKNSASSSVGYGSDSDSQSSITKSGINTRNIQITDEAAQIRLTGKTAAQTKADIDTNVTTDTAERHSGSLKNTFNKEAVQSELDLQRTVSQDFSKNVQQANTEINQHLDKLKADKEAAETAAAEALANGDMETAKRKAHEAQDAAAKADNWQQGKVILNMLASGLAAPTQSGAGIAAATASPAVSYAIGQHFKDLAGQNANGKLTASQETAHVLAHAVLGAAVAAVGDNNALAGALSAGGSEAAAPYISKWLYGKEKGSDLTAEEKETVTAITNVLGTATGAAVGNSATDAAQGSLNAQSAVENNDTVEQVKFALRHPRIAIAIGSVHKDPGSTLEPNISTIASTFQLNLFPNSEFGGEGGVGNAFRHVLWQATITREFGKDIAVKVGNSHESGEKINYSIRRNLSLDKADEMIDQLNNEIGREIALNTNRLNTKELVGLILETYKNNGFYQAERNSNGNYDVVRKRLSEKDYQNTSNILIHLDNTGAGFKIQQRRKQIRAQISARQWRR

SEQ ID NO: 1669 - DNA, 7800 bp, Neisseria meningitidis
atgaaccgcaccctgtacaaagttgtatttaacaaacatcgaaactgcatgatagccgttgctgaaaatgccaaacgcgagggcaaaaacacagccgacacccaagctgtaggtattttgccaaatgatattgcgggctttgcgggttttatccattctatctctgttatctcattctccctttcattactgctcggttctgcccttatcctgacttcttcttctgctactgcccaaggtatcgttgccgacaaatccgcacctgcacagcaacagcctaccatcctgcaaacaggtaacggcataccgcaagtcaatattcaaacccctacttcggcaggggtttctgttaatcaatacgcccagtttgatgtgggtaatcgcggggcgattttaaacaacagtcgcagcaacacccaaacacagctaggcggttggattcaaggcaatccttggttggcaaggggcgaagcacgtgtggttgtaaaccaaatcaacagcagccattcttcacaactgaatggctatattgaagtgggcggacgacgtgcagaagtcgttattgccaatccggcagggattgcagtcaatggtggtggttttatcaatgcttcccgtgccactttgacgacagcccaaccgcaatatcaagcaggagaccttagcggctttaagataaggcaaggcaatgttgtaatcgccggacacggtttggatgcacgtgataccgattacacacgtattctcagttatcattccaaaattgatgcacccgtatggggacaagatgttcgtgtcgtcgcgggacaaaacgatgtggccgcaacaggtgatgcacattcgcctattctcaataatgctgctgccaatacgtcaaacaatacagccaacaacggcacacatatccctttatttgcgattgatacaggcaaattaggaggtatgtatgccaacaaaatcaccttgatcagtacggtcgagcaagcaggcattcgtaatcaagggcaatggtttgcctcagccggcaatgtggcagtgaatgctgagggtaaactggtcaacacgggcatgattgcagcgacgggagaaaatcatgcggtttcacttcatgcccgcaatgttcataatagcggtacggttgcctcacaggatgatgccaatattcacagccagacgctggacaattcaggtacggtcttatcctcaggtcgattgactgttcgtaatttaggccgtctgaaaaaccaaaacaacggtacgatccaggctgcccgcttagatatgtcaacaggtggtttggataacacaggtaatattactcaaacaggttcacaagcattggatttggtatctgccggcaaattcgataacagtggcaagattggtgtaagtgacgttccacagaccggtttgaatcccaatccatcagtcataccacagattccgagtactgcaacaggttcaggcagcagcactgtctcggtatctaagcctggttcaaacaatcccgtttcacctacagcacctgcaaaaaactacgccgtaggacgcattcaaacaacaggagcatttgacaatgcaggatcaattaatgcgggtgggcaaattgacattgccgcccaaaacggtttgggaaattcgggtagtctgaatgcggctaaactacgagtatcaggcgattcatttaacaatacggtaaaaggcaaactccaggcacacgatctggctgttaacactcaaactgctaaaaacagcggtcacttattaactcaaaccggcaagattgataaccgtgaactgcataatgccggagaaattgccgccaacaatctgacactcattcattcgggccgcttgagcaatgataaaaaaggcaatattcgagctgcacatttacagcttgataccgccggtttacataatgcaggtaacattcttgccgatagtggaaccgttaccaccaagaataatcttcgcaatacaggaaaagtttctgttgcacgactgaataccgaaggtcagactctagataatacgcgcggacgtatagaggctgaaacggttaacatccaaagtcagcaactgactaaccaaagcggccatattactgctaccgaacaactgactatcaatagtcgaaatgtagacaaccaaaacggcaaactcctatctgcaaaccaagcacaattagctgtttcagacggcctatacaaccaacatggtgaaattgccaccaaccggcagttgtctattcacgataaaaatcaaaacactttggcgttaaacaatgcggatggcacgattcaatctgccggtaatgtatcgctacaagccaaatcactcgccaacaatggcacattaacagccggtaacaaactggatattgctttgacggacgatttcgtcgtagagcgcgacctcactgcaggcaaacaattaaatctaagcataaaaggccgtctgaaaaatacccataccctacaagcaggccatacgctcaaactcaatgccggcaatatagataaccaagttacaggcaaaattattggtggagaacaaacggacatcacatccgaacagcatgttgacaacaggggcttgatcaacagcgacggtttgacccacatcggtgcaggtcaaaccctgaccaacaccgggacaggcaaaatctatggcaaccatattgccctggacgcgcaaatactgcttaaccgggaagaaacgacggaaggcagtaccaaagcgggggcaatagctgcaaggaaacgtttggatattggagcgaaagagattcataaccaagaaggtgccctactatccagcgaaggtatttttgccgtaggtaatcgactggatgaacaacatcatgcggcaggcatggccgatacctttgttaatggcagtgccggtttggaagtacaaggtgatgcattgatgtccgttcggaatatgcagaatatcaataatcactttaaaacagagacatacttagccaaagcggaaaagcaagtccgcgactacaccgtactggggcaaaatacctactatcaggcgggaaaagacggtttattcgacaactcgcaaggacaaaaagaccaaactactgctacgttccatttaaaaaatggttctcgtattgaggccaaccaatggcatgtccgagactaccacatcgagacttataaagaacgcatcatcgaaaaccggccggcacacattactgtgggcggtgatttgactgcctcaggtcaaaattggctgaacaaagacagccggattgtagtaggcgggcgtattatcactgatgatttaaaccagaaagaaattaccaatcaaagtacaacaggcaaaggtcgcacagatgctgtcggcacacagtgggattcagttacaaaaaaaggatggtacagcggtagaaaaagacaacgccgtactgaaagaaaccatactccttaccatgatacccaactatttacccacgacttcgacacgcctgtatccgtcatccaacagaatgccgcctccccttcctttcaacccgccgcatctgcaatcaaactgattgacggagtatccacggcagccgtcaatggtcagcgcatccataccggtaatgtggtctcgttaaataacgctactgttactctgcctaacagcagcctctataccacccatcctgacaataaaggctggttggttgaaaccgatcctcaatttgcagactaccgccgctggttgggcagcgactacatgttgcaacaactgcaattggacaccaatcatctacacaaacggcttggcgacggctactacgaacaaaaacttgttaatgaacaaatccatcagttaacaggctaccgccgactcgacggctacaggagtgatgaagaacaattcaaagctctgatggacaacggccttactgctgccaaaacattcggtctcaccccaggtatcgccttgagtgcagagcaagttgcccgcttaacttcagatatcgtttggatggaaaatcaaaccgtcaccctgtctgacggttcgactcaaaccgtactggttcctaaagtctatgccctggcgcgcaaaggtgatctcaatacctccggtggcctgattagtgccgaacaagtcttacttaaactgcaaaacggcaacctgactaacagcggtaccattgcggggcgacaggccgtactcatccaggcacggaatattaacagcaacggtaacattcaagccgaccaaatcggcttaaaagctgaaaaaagtatcaatatcgacggcgggcaggtacaagcaggcagactgctgactgcccaagcgcaaaatatcaaccttaacggtacaacccaaacttccggtaatgaacgtaacggcaataccgccatcgatcgtatggccggcattaacgtggtcggaagccatactgaacaagtagataacagaacttcagacggcatcctatccctgcatgccagcaacgatatcaacctcaatgcggccaccgtctctaaccaagttaaagacggcactacccaaattaccgccggcaataatctcaacctcggcaccatccgtaccgaacatcgcgaagcctatggtacattagatgacgagaaccatcgccatgtccgccaaagtaccgaagtcggcagcagtatccgcacgcaaaacggcgcactgcttagagccggtaacgacttaaaaatccgccaaggcgaactggaggccgaagaaggcaaaaccgtccttgccgcaggacgtgatgtcactatcagcgaaggacgccaaataaccgaactggatacctcggtaagcggaaaaagcaaaggcatcctttccagtaccaaaacacacgaccgctaccgcttcagtcatgatgaagcagtcggcagcaacatcggcggcggcaaaatgattgttgcagccgggcaggatatcaatgtacgcggcagcaaccttatttctgataagggcattgttttaaaagcaggacacgacatcgatatttctactgcccataatcgctataccggcaatgaataccacgagagcaaaaaatcaggcgtcatgggtactggcggattgggctttactatcggtaaccggaaaactaccgatgacactgatcgtaccaatattgtccatacaggcagcattataggcagcctgaatggagacaccgttacagttgcaggaaaccgctaccgacaaaccggcagtaccgtctccagccccgaggggcgcaataccgtcacagccaaaagcatagatgtagagttcgcaaacaaccggtatgccactgactacgcccatacccaggaacaaaaaggccttaccgtcgccctcaatgtcccggttgtccaagctgcacaaaacttcatacaagcagcccaaaatgtgggcaaaagtaaaaataaacgcgttaatgccatggctgcagccaatgctgcatggcagagttatcaagcaacccaacaaatgcaacaatttgctccaagcagcagtgcgggacaaggtcaaaacaacaatcaaagccccagtatcagtgtgtccattacctacggcgaacagaaaagtcgtaacgagcaaaaaagacattacaccgaagcggcagcaagtcaaattatcggcaaagggcaaaccacacttgcggcaacaggaagtggggagcagtccaatatcaatattacaggttccgatgtcatcggccatgcaggtactgccctcattgccgacaaccatatcagactccaatctgccaaacaggacggcagcgagcaaagcaaaaacaaaagcagtggttggaatgcaggcgtagccgtcaaaataggcaacggcatcaggtttggaattaccgccggaggaaatatcggtaaaggtaaagagcaagggggaagtactacccaccgccacacccatgtcggcagcacaaccggcaaaactaccatccgaagcggcggggataccaccctcaaaggtgtgcagctcatcggcaaaggcatacaggcagatacgcgcaacctgcatatagaaagtgttcaagatactgaaacctatcagagcaaacagcaaaacggcaatgtccaagttactgtcggttacggattcagtgcaagcggcagttaccgccaaagcaaagtcaaagcagaccatgcctccgtaaccgggcaaagcggtatttatgccggagaagacggctatcaaatcaaagtcagagacaacacagacctcaagggcggtatcatcacgtctagccaaagcgcagaagataagggcaaaaacctttttcagacggccacccttactgccagcgacattcaaaaccacagccgctacgaaggcagaagcttcggcataggcggcagtttcgacctgaacggcggctgggacggcacggttaccgacaaacaaggcaggcctaccgacaggataagcccggcagccggctacggcagcgacggagacagcaaaaacagcaccacccgcagcggcgtcaacacccacaacatacacatcaccgacgaagcgggacaacttgcccgaacaggcaggactgcaaaagaaaccgaagcgcgtatctacaccggcatcgacaccgaaactgcggatcaacactcaggccatctgaaaaacagcttcgacaaagacgcggtcgccaaagagatcaacctgcaaagggaagtaacgaaggagttcggcagaaacgccgcccaagccgtagcggccgttgccgacaaactcggcaatacccaaagttacgaacggtatcaggaagcccgaaccctgctggaggccgaactgcaaaacacggacagcgaagccgaaaaagccgccttccgcgcatccctcggccaagtaaacgcctatcttgccgaaaaccaaagccgctacgacacctggaaagaaggcggcataggcaggagcatactgcacggggcggcaggcggactgacgaccggcagcctcggcggcatactggccggcggcggcacttcccttgccgcaccgtatttggacaaagcggcggaaaacctcggtccggcgggcaaagcggcggtcaacgcactgggcggtgcggccatcggctatgcaactggtggtagtggtggtgctgtggtgggtgcgaatgtagattggaacaataggcagctgcatccgaaagaaatggcgttggccgacaaatatgccgaagccctcaagcgcgaagttgaaaaacgcgaaggcagaaaaatcagcagccaagaagcggcaatgagaatccgcaggcagatactgcgttgggtggacaaaggttcccaagacggctataccgaccaaagcgtcatatcccttatcggaatgaaaggcgaagacaaagccttgggttatacttgggactaccgcgactacggcgcaagaaatccgcaaacctacaacgatccgaagctgtttgaggaataccgccgacaggacaaacccgaataccgcaacctgacctggctgcacagcgggacgaaagacaccaaaatcaggcagggagagcggaaaaacgaagagtttgcactgaacgttgccgaaggactgacgagccttgtcaaccccaatccgaggataaaagtcccgattcttgcaggcatccgcaacctgaaaaacatcaagccgacagttaccggcagcgatcccttattggcgggtgcggggaatatccgtatccctgcaaacggcaatgttgcgaagggggacaggattccggatacggcattggctagcaagggaatcaaacataaagatcgtaaagatcaactggagaaaaaataa

SEQ ID NO: 1670 - protein, 2599 aa, Neisseria meningitidis
MNRTLYKVVFNKHRNCMIAVAENAKREGKNTADTQAVGILPNDIAGFAGFIHSISVISFSLSLLLGSALILTSSSATAQGIVADKSAPAQQQPTILQTGNGIPQVNIQTPTSAGVSVNQYAQFDVGNRGAILNNSRSNTQTQLGGWIQGNPWLARGEARVVVNQINSSHSSQLNGYIEVGGRRAEVVIANPAGIAVNGGGFINASRATLTTAQPQYQAGDLSGFKIRQGNVVIAGHGLDARDTDYTRILSYHSKIDAPVWGQDVRVVAGQNDVAATGDAHSPILNNAAANTSNNTANNGTHIPLFAIDTGKLGGMYANKITLISTVEQAGIRNQGQWFASAGNVAVNAEGKLVNTGMIAATGENHAVSLHARNVHNSGTVASQDDANIHSQTLDNSGTVLSSGRLTVRNLGRLKNQNNGTIQAARLDMSTGGLDNTGNITQTGSQALDLVSAGKFDNSGKIGVSDVPQTGLNPNPSVIPQIPSTATGSGSSTVSVSKPGSNNPVSPTAPAKNYAVGRIQTTGAFDNAGSINAGGQIDIAAQNGLGNSGSLNAAKLRVSGDSFNNTVKGKLQAHDLAVNTQTAKNSGHLLTQTGKIDNRELHNAGEIAANNLTLIHSGRLSNDKKGNIRAAHLQLDTAGLHNAGNILADSGTVTTKNNLRNTGKVSVARLNTEGQTLDNTRGRIEAETVNIQSQQLTNQSGHITATEQLTINSRNVDNQNGKLLSANQAQLAVSDGLYNQHGEIATNRQLSIHDKNQNTLALNNADGTIQSAGNVSLQAKSLANNGTLTAGNKLDIALTDDFVVERDLTAGKQLNLSIKGRLKNTHTLQAGHTLKLNAGNIDNQVTGKIIGGEQTDITSEQHVDNRGLINSDGLTHIGAGQTLTNTGTGKIYGNHIALDAQILLNREETTEGSTKAGAIAARKRLDIGAKEIHNQEGALLSSEGIFAVGNRLDEQHHAAGMADTFVNGSAGLEVQGDALMSVRNMQNINNHFKTETYLAKAEKQVRDYTVLGQNTYYQAGKDGLFDNSQGQKDQTTATFHLKNGSRIEANQWHVRDYHIETYKERIIENRPAHITVGGDLTASGQNWLNKDSRIVVGGRIITDDLNQKEITNQSTTGKGRTDAVGTQWDSVTKKGWYSGRKRQRRTERNHTPYHDTQLFTHDFDTPVSVIQQNAASPSFQPAASAIKLIDGVSTAAVNGQRIHTGNVVSLNNATVTLPNSSLYTTHPDNKGWLVETDPQFADYRRWLGSDYMLQQLQLDTNHLHKRLGDGYYEQKLVNEQIHQLTGYRRLDGYRSDEEQFKALMDNGLTAAKTFGLTPGIALSAEQVARLTSDIVWMENQTVTLSDGSTQTVLVPKVYALARKGDLNTSGGLISAEQVLLKLQNGNLTNSGTIAGRQAVLIQARNINSNGNIQADQIGLKAEKSINIDGGQVQAGRLLTAQAQNINLNGTTQTSGNERNGNTAIDRMAGINVVGSHTEQVDNRTSDGILSLHASNDINLNAATVSNQVKDGTTQITAGNNLNLGTIRTEHREAYGTLDDENHRHVRQSTEVGSSIRTQNGALLRAGNDLKIRQGELEAEEGKTVLAAGRDVTISEGRQITELDTSVSGKSKGILSSTKTHDRYRFSHDEAVGSNIGGGKMIVAAGQDINVRGSNLISDKGIVLKAGHDIDISTAHNRYTGNEYHESKKSGVMGTGGLGFTIGNRKTTDDTDRTNIVHTGSIIGSLNGDTVTVAGNRYRQTGSTVSSPEGRNTVTAKSIDVEFANNRYATDYAHTQEQKGLTVALNVPVVQAAQNFIQAAQNVGKSKNKRVNAMAAANAAWQSYQATQQMQQFAPSSSAGQGQNNNQSPSISVSITYGEQKSRNEQKRHYTEAAASQIIGKGQTTLAATGSGEQSNINITGSDVIGHAGTALIADNHIRLQSAKQDGSEQSKNKSSGWNAGVAVKIGNGIRFGITAGGNIGKGKEQGGSTTHRHTHVGSTTGKTTIRSGGDTTLKGVQLIGKGIQADTRNLHIESVQDTETYQSKQQNGNVQVTVGYGFSASGSYRQSKVKADHASVTGQSGIYAGEDGYQIKVRDNTDLKGGIITSSQSAEDKGKNLFQTATLTASDIQNHSRYEGRSFGIGGSFDLNGGWDGTVTDKQGRPTDRISPAAGYGSDGDSKNSTTRSGVNTHNIHITDEAGQLARTGRTAKETEARIYTGIDTETADQHSGHLKNSFDKDAVAKEINLQREVTKEFGRNAAQAVAAVADKLGNTQSYERYQEARTLLEAELQNTDSEAEKAAFRASLGQVNAYLAENQSRYDTWKEGGIGRSILHGAAGGLTTGSLGGILAGGGTSLAAPYLDKAAENLGPAGKAAVNALGGAAIGYATGGSGGAVVGANVDWNNRQLHPKEMALADKYAEALKREVEKREGRKISSQEAAMRIRRQILRWVDKGSQDGYTDQSVISLIGMKGEDKALGYTWDYRDYGARNPQTYNDPKLFEEYRRQDKPEYRNLTWLHSGTKDTKIRQGERKNEEFALNVAEGLTSLVNPNPRIKVPILAGIRNLKNIKPTVTGSDPLLAGAGNIRIPANGNVAKGDRIPDTALASKGIKHKDRKDQLEKK

SEQ ID NO: 1671 - DNA, 327 bp, Neisseria gonorrhoeae
atggacagcacattgtctaaaacgtgttgcgtttcgtgcatattgttgagcgtaaccaccaccattttcgcccgtcccagaccggcggcttccaatacttccctgcgtttcgcatcgccgaacgacaccggctcgcctgcacttctggctacctgcacgcgtgcgatgtccaagtcgagcgcgaaatacggaatatcctctttgggcgaagacgcgtccgaccgtctgcccgcccctgccgaagccgacaatcagcacatgatcagacttgctcatcgcttccaccaacatgctgtgcagatcgagcgacttcatgtcccagcttga

SEQ ID NO: 1672 - protein, 108 aa, Neisseria gonorrhoeae
MDSTLSKTCCVSCILLSVTTTIFARPRPAASNTSLRFASPNDTGSPALLATCTRAMSKSSAKYGISSLGEDASDRLPAPAEADNQHMIRLAHRFHQHAVQIERLHVPA

SEQ ID NO: 1673 - DNA, 630 bp, Neisseria meningitidis
atggacagcacattgtctaaaacgtgttgcgtttcgtgcatattgttgagcgtaaccaccaccattttcgcccgtcccagaccggcggcttccaatacttccctgcgtttcgcatcgccgaacgacaccggttcgcccgcacttctggcaacctgcacccgcgcaatgtccaagtcgagcgcgaaatacggaatatcctcttgggcaaggacgcgtccgaccgtctgcccgcccctgccgaagccgacaatcagcacatggtcggacttgctcatggtttctaccagcatactgtgcagatcgagcgacttcatgtcccagcttgacttgaccaaacgcccgaccagcgcatcgctgccgcccaagaggaagggcgcgataatcatcgacagcagaaccgccgccgtcgccgcctgttcccattctggcgaaaccatatcaagctgcccggcaatggccagcatcacgaagccgaactcgccgccctgcgcgagatacaaagccgttttgaggctgtcgccgaccgaatgtttcattttgaaggcaatggcaaacacaaccagtgccttcaacaccagcagcattgccaacagcatcaatacctgccgccagccgccgatcaatgcctga

SEQ ID NO: 1674 - protein, 209 aa, Neisseria meningitidis
MDSTLSKTCCVSCILLSVTTTIFARPRPAASNTSLRFASPNDTGSPALLATCTRAMSKSSAKYGISSWARTRPTVCPPLPKPTISTWSDLLMVSTSILCRSSDFMSQLDLTKRPTSASLPPKRKGAIIIDSRTAAVAACSHSGETISSCPAMASITKPNSPPCARYKAVLRLSPTECFILKAMANTTSAFNTSSIANSINTCRQPPINA

SEQ ID NO: 1675 - DNA, 630 bp, Neisseria meningitidis
atggacagcacattgtctaaaacgtgttgcgtttcgtgcatattgttgagcgtaaccaccaccattttcgcccgtcccagaccggcggcttccaatacttccctgcgtttcgcatcgccgaacgacaccggttcgcccgcacttctggcaacctgcacccgcgcaatgtccaagtcgagcgcgaaatacggaatatcctcttgggcaaggacgcgtccgaccgtctgcccgcccctgccgaagccgacaatcagcacatggtcggacttgctcatggtttctaccagcatactgtgcagatcgagcgacttcatgtcccagcttgacttgaccaaacgcccgaccagtgcatcgctgccgcccaagaggaagggcgcgataatcatcgacagcagaaccgccgccgtcgccgcctgttcccattctagcgaaaccatatcaagctgcccggcaatggccagcatcacgaagccgaactcgccgccctgcgcgagatacaaagccgttttgaggctgtcgccgaccgaatgtttcattttgaaggcaatggcaaacacaaccagtgccttcaacaccagcagcattgccaacagcatcaatacctgccgccagccgccgattaatgcctga

SEQ ID NO: 1676 - protein, 209 aa, Neisseria meningitidis
MDSTLSKTCCVSCILLSVTTTIFARPRPAASNTSLRFASPNDTGSPALLATCTRAMSKSSAKYGISSWARTRPTVCPPLPKPTISTWSDLLMVSTSILCRSSDFMSQLDLTKRPTSASLPPKRKGAIIIDSRTAAVAACSHSSETISSCPAMASITKPNSPPCARYKAVLRLSPTECFILKAMANTTSAFNTSSIANSINTCRQPPINA

SEQ ID NO: 1677 - DNA, 351 bp, Neisseria gonorrhoeae
atgccgtctgaacaatatcttttcagacggcattttgtatgggggttaacggttgttcagcccgagtacgtcctgcatatcgtacaaacccgttttgccgtttacccaaactgcggcgcggacggcaccggcggcaaaggtcatgcggctgccggctttgtgggtgatttccacgcgttcgccgtcggtggcgaagagggcggtgtggtcgccgactatgtcgcctgcgcggacggtggcaaagccgatggtggaaggatcgcgcggaccagtgtggccttcgcggccgtaaacggcgcattgtttgaggtcgcggccgagcgcgccggcgatgacttcgcccattcgtaa

SEQ ID NO: 1678 - protein, 116 aa, Neisseria gonorrhoeae
MPSEQYLFRRHFVWGLTVVQPEYVLHIVQTRFAVYPNCGADGTGGKGHAAAGFVGDFHAFAVGGEEGGVVADYVACADGGKADGGRIARTSVAFAAVNGALFEVAAERAGDDFAHS

SEQ ID NO: 1679 - DNA, 351 bp, Neisseria meningitidis
atgccgtctgaacaatatcttttcagacggcattttgtatgggggttaacggttgttcagcccgagtacgtcctgcatatcgtacaaacccgttttgccgttgacccaaactgcggcgcggacggcaccggcggcaaaggtcatgcggctgctggccttgtgggtgatttccacgcgctcgccgtcggtggcgaagagggcggtgtggtcgccgacgatgtcgcctgcgcggacggtggcaaagccgatggtcgacggatcgcgcggaccggtgtggccttcgcggccgtaaacggcgcattgtttgaggtctctgccgagcgcgccggcgatgacttcgcccatgcgtaa

SEQ ID NO: 1680 - protein, 116 aa, Neisseria meningitidis
MPSEQYLFRRHFVWGLTVVQPEYVLHIVQTRFAVDPNCGADGTGGKGHAAAGLVGDFHALAVGGEEGGVVADDVACADGGKADGRRIARTGVAFAAVNGALFEVSAERAGDDFAHA

SEQ ID NO: 1681 - DNA, 351 bp, Neisseria meningitidis
atgccgtctgaacaatatcttttcagacggcattttgtatgggggttaacggttgttcagcccgagtacgtcctgcatatcgtacaaacccgttttaccgtttacccaaactgcggcgcggacggcgccggcggcaaaggtcatgcggctgcttgccttgtgggtgatttccacgcgctcgccgtcggtggcgaagagggcggtgtggtcgccgacgatgtcgcccgcgcggacggtggcaaagccgatggtggacggatcgcgcgggccggtgtggccttcgcggccgtaaacggcgcattgtttgaggtctctgccgagcgcgccggcgatgacttcgcccatgcgtaa

SEQ ID NO: 1682 - protein, 116 aa, Neisseria meningitidis
MPSEQYLFRRHFVWGLTVVQPEYVLHIVQTRFTVYPNCGADGAGGKGHAAACLVGDFHALAVGGEEGGVVADDVARADGGKADGGRIARAGVAFAAVNGALFEVSAERAGDDFAHA

SEQ ID NO: 1683 - DNA, 642 bp, Neisseria gonorrhoeae
atgcgacgacgggcagcggcatcgacaaggcgggtttgcagtccggcgtttatcaggtcttattgggcgatgcggacgtgcagtcggcggcggtacgcagcaaagagggcggatacggcgtgttgggtgcgaacgcgcgcgcttgccggcgcggaaatcgagctggtgcaggaaatcgcccgggaagtgcgtttgaaaaacgcgctcaaggcagtggcggaagattacgactttatcctgatcgactgtccgccttcgctgacgctgttgacgcttaacggcttggtggcggcgggcggcgtgattgtgccgatgttgtgcgaatattacgcgctggaagggatttccgatttgattgcgaccgtgcgcaaaatccgtcaggcggtcaatcccgatttggacatcacgggcatcgtgcgtacgatgtacgacagccgcagcaggctggttgccgaagtcagcgaacagttgcgcagccatttcggggatttgctttttgaaaccgccatcccgcgcaatatccgccttgcggaagcgccgagccacggtatgccggtgatggcttacgacgcgcaggcaaagggtgccaaggcgtatcttgccttggcggacgaactggcggcgagggtgtcggggaaatag

SEQ ID NO: 1684 - protein, 213 aa, Neisseria gonorrhoeae
MRRRAAASTRRVCSPAFIRSYWAMRTCSRRRYAAKRADTACWVRTRALAGAEIELVQEIAREVRLKNALKAVAEDYDFILIDCPPSLTLLTLNGLVAAGGVIVPMLCEYYALEGISDLIATVRKIRQAVNPDLDITGIVRTMYDSRSRLVAEVSEQLRSHFGDLLFETAIPRNIRLAEAPSHGMPVMAYDAQAKGAKAYLALADELAARVSGK

SEQ ID NO: 1685 - DNA, 774 bp, Neisseria meningitidis
atgagtgcgaacatccttgccatcgccaatcagaagggcggtgtgggcaaaacgacgacgacggtaaatttggcggcttcgctggcatcgcgcggcaaacgcgtgctggtggtcgatttggatccgcagggcaatgcgacgacgggcagcggcatcgacaaggcgggtttgcagtccggcgtttatcaggtcttattgggcgatgcggacgtgcagtcggcggcggtacgcagcaaagagggcggatacgctgtgttgggtgcgaaccgcgcgctggccggcgcggaaatcgaactggtgcaggaaatcgcccgggaagtgcgtttgaaaaacgcgctcaaggcagtggaagaagattacgactttatcctgatcgactgcccgccttcgctgacgctgttgacgcttaacgggctggtggcggcgggcggcgtgattgtgccgatgttgtgcgaatattacgcgctggaagggatttccgatttgattgcgaccgtgcgcaaaatccgtcaggcggtcaatcccgatttggacatcacgggcatcgtgcgcacgatgtacgacagccgcagcaggctggttgccgaagtcagcgaacagttgcgcagccatttcggggatttgctttttgaaaccgtcatcccgcgcaatatccgccttgcggaagcgccgagccacggtatgccggtgatggcttacgacgcgcaggcaaagggtaccaaggcgtatcttgccttggcggacgagctggcggcgagggtgtcggggaaatag

SEQ ID NO: 1686 - protein, 257 aa, Neisseria meningitidis
MSANILAIANQKGGVGKTTTTVNLAASLASRGKRVLVVDLDPQGNATTGSGIDKAGLQSGVYQVLLGDADVQSAAVRSKEGGYAVLGANRALAGAEIELVQEIAREVRLKNALKAVEEDYDFILIDCPPSLTLLTLNGLVAAGGVIVPMLCEYYALEGISDLIATVRKIRQAVNPDLDITGIVRTMYDSRSRLVAEVSEQLRSHFGDLLFETVIPRNIRLAEAPSHGMPVMAYDAQAKGTKAYLALADELAARVSGK

SEQ ID NO: 1687 - DNA, 774 bp, Neisseria meningitidis
atgagtgcgaacatccttgccatcgccaatcagaagggcggtgtgggcaaaacgacgacgacggtaaatttggcggcttcgctggcatcgcgcggcaaacgcgtgctggtggtcgatttggatccgcagggcaatgcgacgacgggcagcggcatcgacaaggcgagtttgcagtccggcgtttatcaggtcttattgggcgatgcggacgtgaaatcggcggcggtacgcagcaaagagggcggatacggcgtgttgggtgcgaaccgcgcgctggccggcgcggaaatcgagctggtgcaggaaatcgcccgggaagtgcgtttgaaaaacgcgctcaaggcagtggcggaagattacgactttatcctgatcgactgcccgccttcgctgacgctgttgacgcttaacggcttggtggcggcaggcggcgtgattgtgccgatgttgtgcgaatattacgcgctggaagggatttccgatttgattgcgaccgtgcgcaaaatccgtcaggcggtcaatcccgatttggatatcacgggcatcgtgcgtacgatgtacgacagccgcagcaggctagttgccgaagtcagcgaacagttgcgcagccatttcggggatttgctgtttgaaaccgtcatcccgcgcaatatccgccttgcggaagcgccgagccacggtatgccggtgatggcttatgatgcgcaggcaaagggtgccaaggcgtatcttgccttggcggacgagctgatggcgagggtgtcggggaaatag

SEQ ID NO: 1688 - protein, 257 aa, Neisseria meningitidis
MSANILAIANQKGGVGKTTTTVNLAASLASRGKRVLVVDLDPQGNATTGSGIDKASLQSGVYQVLLGDADVKSAAVRSKEGGYGVLGANRALAGAEIELVQEIAREVRLKNALKAVAEDYDFILIDCPPSLTLLTLNGLVAAGGVIVPMLCEYYALEGISDLIATVRKIRQAVNPDLDITGIVRTMYDSRSRLVAEVSEQLRSHFGDLLFETVIPRNIRLAEAPSHGMPVMAYDAQAKGAKAYLALADELMARVSGK

SEQ ID NO: 1689 - DNA, 465 bp, Neisseria gonorrhoeae
atgctcagggtcagaccggtattatttgccgtcaaggcttccgcctcttcgataccttgcagaatctgccgattaaagcgttcgcggctgcccaatattttcaggcgcatattgttttcgtgcaggcggcgtacctgtttttgcaaagcctgtaaaaacagccccatcaggaacgaaacttcgtcttcggggcgacgccagttttcggttgaaaaggcaaacacggtcagatattgcacgcccagtttggcgcaatgcttcaccatattttccaacgcgtccaagccgcgtttgtgtcccattatacgcgggagaaaacgttttttcgcccaacggccgttgccgtccataattacggcgatgtgcctcgggatggcggtgtgttccaaaatggtctgcgtgctgctcttcatatctgcctttcgcggttcggcgttcaaatgccgtctgaacgccgcgccgtga

SEQ ID NO: 1690 - protein, 154 aa, Neisseria gonorrhoeae
MLRVRPVLFAVKASASSIPCRICRLKRSRLPNIFRRILFSCRRRTCFCKACKNSPIRNETSSSGRRQFSVEKANTVRYCTPSLAQCFTIFSNASKPRLCPIIRGRKRFFAQRPLPSIITAMCLGMAVCSKMVCVLLFISAFRGSAFKCRLNAAP

SEQ ID NO: 1691 - DNA, 774 bp, Neisseria meningitidis
atgctcagggtcaggccggtattgtttgccgtcaacgcttccgcctcttcgatgccttgcagaatctgccggttgaagcgttcgcggctgcccaatatcttcaggcgcatattgttttcgtgcaggcggcgtacctgtttttgcaaagcctgtaaaaacagccccatcaggaacgaaacttcgtcttcggggcggcgccagttttcggttgaaaaggcaaacacggtcagatattgcacacccagtttggcgcaatgcttcaccatattttccaatgcgtccaaaccgcgtttgtgtcccattatgcgcgggaggaaacgttttttcgcccaacggccgttgccgtccataatcacggcgatatgcttgggaatggcggtgtgttccaaaacggcctgcgtgctgcttttcatgtctgcctttcgcggttcggcattcaaatgccgtctgaacgccgaaccgtgcaggttaaattgccatcaaatcttcttctttggcagtcaggagtttgtcggcttcggtaatgtatttgtcggtcagtttttgaaccgcttcttcgccgcgacgtgcctcgtcttcggaaatttctttgtctttgaggagttttttgatgtggtcgttggcatcgcggcgcacgttgcggatagagacgcggccttcttccgcttcgccgcgtacgactttaatcaggtctttgcggcgttcctcggtcagcatgggcatcggcacgcggatcaggtcgccgacagctgccgggttcagtcccaagtttga

SEQ ID NO: 1692 - protein, 257 aa, Neisseria meningitidis
MLRVRPVLFAVNASASSMPCRICRLKRSRLPNIFRRILFSCRRRTCFCKACKNSPIRNETSSSGRRQFSVEKANTVRYCTPSLAQCFTIFSNASKPRLCPIMRGRKRFFAQRPLPSIITAICLGMAVCSKTACVLLFMSAFRGSAFKCRLNAEPCRLNCHQIFFFGSQEFVGFGNVFVGQFLNRFFAATCLVFGNFFVFEEFFDVVVGIAAHVADRDAAFFRFAAYDFNQVFAAFLGQHGHRHADQVADSCRVQSQV

SEQ ID NO: 1693 - DNA, 774 bp, Neisseria meningitidis
atgctcagggtcaggccggtattgtttgccgtcaaggcttccgcctcttcgatgcccttcaggatttgacggttgaagcgttcgcggctgcccagtattttcaggcgcatattgttttcgtgcaggcggcgtacctgtttttgcaaagcctgtaaaaacagccccatcaggaacgaaacttcgtcttcggggcggcgccagttttcggttgaaaaggcaaacacggtcagatattgcacacccagtttggcgcaatgcttcaccatattttccaatgcgtccaaaccgcgtttgtgtcccattatgcgcgggaggaaacgttttttcgcccaacggccgttgccgtccataatcacggcgatatgcttgggaatggcggtgtgttccaaaacggcctgcgtgctgcttttcatgtctgcctttcgcggttcggcattcaaatgccgtctgaacgccgaaccgtgcaggttaaattgccatcaaatcttcttctttggcagtcaggagtttgtcggcttcggtaatgtatttgtcggtcagtttttgaaccgcttcttcgccgcgacgtgcctcgtcttcggaaatttctttgtctttgaggagttttttgatgtggtcgttggcatcgcggcgcacgttgcggatggagacgcggccttcttccgcttcgccgcgtacgactttaatcaggtctttgcggcgttcctcggtcagcatgggcatcggcacgcggatcaggtcgccgacagctgccgggttcagtcccaagtttga

SEQ ID NO: 1694 - protein, 256 aa, Neisseria meningitidis
MLRVRPVLFAVKASASSMPFRIRLKRSRLPSIFRRILFSCRRRTCFCKACKNSPIRNETSSSGRRQFSVEKANTVRYCTPSLAQCFTIFSNASKPRLCPIMRGRKRFFAQRPLPSIITAICLGMAVCSKTACVLLFMSAFRGSAFKCRLNAEPCRLNCHQIFFFGSQEFVGFGNVFVGQFLNRFFAATCLVFGNFFVFEEFFDVVVGIAAHVADGDAAFFRFAAYDFNQVFAAFLGQHGHRHADQVADSCRVQSQV

SEQ ID NO: 1695 - DNA, 393 bp, Neisseria gonorrhoeae
atgctgaaacaacgggtaataaccgctatgtggctgctgccgctgatgctgggcatgctgttttacgcgccgcaatggctgtgggctgcattttgcgggctgattgccctgaccgccttgtgggagtatgcccgtatggccggtttgtgcaaaaccgaaaccaaccattacctcgccgcaaccttggttttcggcgtagttgcctatgcgggcggctggatgctgcctaatttggtttggtatgttgttttggcattttggctcgccgttatgcctttgtggttgagattcaaatggaggctcaacggcggttggcaggtttatgccgtcggctggcttttgctcatgccgttttggttcgcgctcgtatccctggcgcccgcatcccgatga

SEQ ID NO: 1696 - protein, 130 aa, Neisseria gonorrhoeae
MLKQRVITAMWLLPLMLGMLFYAPQWLWAAFCGLIALTALWEYARMAGLCKTETNHYLAATLVFGVVAYAGGWMLPNLVWYVVLAFWLAVMPLWLRFKWRLNGGWQVYAVGWLLLMPFWFALVSLAPASR

SEQ ID NO: 1697 - DNA, 798 bp, Neisseria meningitidis
atgctgaaacaacgggtaataaccgccatgtggctgctgccgctgatgctgggcatgctgttttacgcgccgcaatggttgtgggctgcattttgcggactgattgccctgattgccttgtgggaatatgcccgtatgggcggtttgtgcaaaattaaaaccaaccattacctcgccgcaaccttggttttcggcgtggttgcctatgcgggcggctggatgctgcctaatttggtttggtatgttgttttggcattttggctcgccgttatgcctttatggttgagattcaaatggaggctcaacggcggttggcaggtttatgccgtcggctggcttctggtcatgccgttttggttcgcgctcgtatccctgcgcccgcatcccgatgatgccctgccgctgctcgccgtgatgggtttggtgtgggttgccgatatttgcgcgtatttcagcggcaaggcgttcggcaaacacaaaatcgcgccggcaatcagccccggcaaaagctgggaaggtgcaatcggcggcgcggtttgcgtggcagtgtacatgaccgccgtacgaagtgccggctggctggcattcgatacaggctggttcgataccgtgttaatcggtttggtgctgaccgttgtcagcgtatgcggcgaccttttggaaagctggctcaagcgcgcggcaggcatcaaagacagcagcaagctgctgcccggacacggcggcgtgttcgaccgtaccgacagcctgattgccgttatcagcgtctatgcagcgatgatgtcggttttaaattga

SEQ ID NO: 1698 - protein, 265 aa, Neisseria meningitidis
MLKQRVITAMWLLPLMLGMLFYAPQWLWAAFCGLIALIALWEYARMGGLCKIKTNHYLAATLVFGVVAYAGGWMLPNLVWYVVLAFWLAVMPLWLRFKWRLNGGWQVYAVGWLLVMPFWFALVSLRPHPDDALPLLAVMGLVWVADICAYFSGKAFGKHKIAPAISPGKSWEGAIGGAVCVAVYMTAVRSAGWLAFDTGWFDTVLIGLVLTVVSVCGDLLESWLKRAAGIKDSSKLLPGHGGVFDRTDSLIAVISVYAAMMSVLN

SEQ ID NO: 1699 - DNA, 798 bp, Neisseria meningitidis
atgctgaaacaacgggtgataaccgccatgtggctgctgccgctgatgctgggcatgctgttttacgcgccgcaatggttgtgggctgcattttgcggactgattgccctgattgccttgtgggaatatgcccgtatgggcggtttgtgcaaaattaaaaccaaccattacctcgccgcaaccttggttttcggcgtggttgcctatgcgggcggctggatgctgcctaatttggtttggtatgttgttttggcattttggctcgccgttatgcctttatggttgagattcaaatggaggctcaacggcggttggcaggtttatgccgtcggctggcttctggtcatgccgttttggttcgcgctcgtatccctgcgcccgcatcccgatgatgccctgccgctgctcgccgtgatgggtttggtgtgggttgccgatatttgcgcgtatttcagcggcaaggcgttcggcaaacacaaaatcgcaccggcaatcagccccggcaaaagctgggaaggtgcaatcggcggcgcggtttgcgtggccgtgtacatgaccgccgtacgaagtgccggctggctggcattcgatacaggctggttcgataccgtgttaatcggtttggtgttgaccgttgtcagcgtatgcggcgaccttttggaaagctggctcaagcgcgcggcaggcatcaaagacagcagcaacctgctgcccggacacggcggcgtgttcgaccgcaccgacagcctgattgccgttatcagcgtctatgcagcgatgatgtcggttttaaattga

SEQ ID NO: 1700 - protein, 265 aa, Neisseria meningitidis
MLKQRVITAMWLLPLMLGMLFYAPQWLWAAFCGLIALIALWEYARMGGLCKIKTNHYLAATLVFGVVAYAGGWMLPNLVWYVVLAFWLAVMPLWLRFKWRLNGGWQVYAVGWLLVMPFWFALVSLRPHPDDALPLLAVMGLVWVADICAYFSGKAFGKHKIAPAISPGKSWEGAIGGAVCVAVYMTAVRSAGWLAFDTGWFDTVLIGLVLTVVSVCGDLLESWLKRAAGIKDSSNLLPGHGGVFDRTDSLIAVISVYAAMMSVLN

SEQ ID NO: 1701 - DNA, 501 bp, Neisseria gonorrhoeae
atgatccgtttgacccgcgcgtttgccgccgccctgatcggtttatgctgcaccacaggcgcgcacgccgacaccttccaaaaaatcggctttatcaacaccgagcgcatctacctcgaatccaagcaggcgcgcaacatccaaaaaacgctggacggcgaattttccgcccgtcaggacgaattgcaaaaactgcaacgcgaaggcttggatttggaaaggcagctcgccggcggcaaacttaaggacgcaaaaaaggcgcaagccgaagaaaaatggcgcgggctggtcgaagcgttccgcaaaaaacaggcgcagtttgaagaagactacaacctccgccgcaacgaagagtttgcctccctccagcaaaacgccaaccgcgtcatcgtcaaaatcgccaaacaggaaggttacgatgtcattttgcaggacgtgatttacgtcaacacccaatacgacgttaccgacagcgtcattaaagaaatgaacgcccgctga

SEQ ID NO: 1702 - protein, 166 aa, Neisseria gonorrhoeae
MIRLTRAFAAALIGLCCTTGAHADTFQKIGFINTERIYLESKQARNIQKTLDGEFSARQDELQKLQREGLDLERQLAGGKLKDAKKAQAEEKWRGLVEAFRKKQAQFEEDYNLRRNEEFASLQQNANRVIVKIAKQEGYDVILQDVIYVNTQYDVTDSVIKEMNAR

SEQ ID NO: 1703 - DNA, 501 bp, Neisseria meningitidis
atgacccgtttgacccgcgcgtttgccgcggctctgatcggtttgtgctgcaccgcaggcgcgcacgccgacaccttccaaaaaatcggctttatcaacaccgagcgcatctacctcgaatccaagcaggcgcgcaagattcaaaaaacgctggacagcgaattttccgctcgtcaggacgaattgcaaaaactgcaacgcgaaggtctggatttggaaaggcagcttgccgaaggcaaactcagaaacgcaaaaaaggcgcaagccgaagaaaaatggcgcgggctggtcgcagcgttccgcaaaaaacaggcgcagtttgaagaagactacaacctccgccgcaacgaagagtttgcctccctccagcaaaacgccaaccgcgtcatcgtcaaaatcgccaaacaggaaggttacgatgtcattttgcagaacgtgatttacgtcaacacccaatacgacgttaccgacagcgtcattaaagaaatgaacgcccgctga

SEQ ID NO: 1704 - protein, 166 aa, Neisseria meningitidis
MTRLTRAFAAALIGLCCTAGAHADTFQKIGFINTERIYLESKQARKIQKTLDSEFSARQDELQKLQREGLDLERQLAEGKLRNAKKAQAEEKWRGLVAAFRKKQAQFEEDYNLRRNEEFASLQQNANRVIVKIAKQEGYDVILQNVIYVNTQYDVTDSVIKEMNAR

SEQ ID NO: 1705 - DNA, 501 bp, Neisseria meningitidis
atgacccgtttgacccgcgcgtttgccgcggctctgatcggtttgtgctgcaccgcaggcgcgcacgccgacaccttccaaaaaatcggctttatcaacaccgagcgcatctacctcgaatccaagcaggcgcgcaagattcaaaaaacgctggacagcgaattttccgcccgccaggacgaattgcaaaaactgcaacgcgaaggtctggatttggaaaggcagcttgccgaaggcaaactcaaagacgcaaaaaaggcgcaagccgaagaaaaatggtgcgggctggtcgcagcgttccgcaaaaaacaggcgcagtttgaagaagactacaacctccgccgcaacgaagagtttgcctccctccagcaaaacgccaaccgcgtcatcgtcaaaatcgccaaacaggaaggttacgatgtcattttgcaggacgtgatttacgtcaacacccaatacgacgttaccgacagcgtcattaaagaaatgaacgcccgctga

SEQ ID NO: 1706 - protein, 166 aa, Neisseria meningitidis
MTRLTRAFAAALIGLCCTAGAHADTFQKIGFINTERIYLESKQARKIQKTLDSEFSARQDELQKLQREGLDLERQLAEGKLKDAKKAQAEEKWCGLVAAFRKKQAQFEEDYNLRRNEEFASLQQNANRVIVKIAKQEGYDVILQDVIYVNTQYDVTDSVIKEMNAR

SEQ ID NO: 1707 - DNA, 357 bp, Neisseria gonorrhoeae
atgcgcgttttccgagtaaaccgatttgttgttaccgttttcggcggcggtataggttctgccgtcccacacgctgcctgcgtcggcaaacaggctcaggcggacggtgcgtgcgtctttcgcaccgggcatcgggaagagcagctcggcggagacgttggcttttttgttgccgccgtagctgattttttcgccgtattcgtcatacactttcgggccgagcgtgccgctttcgtagccgcgcaccgaacccaggccgccgccgtagaagttttcaaagaaggggatttctttggttctgccgtagccgcccgcaatgccgacttcgccgccgagcatcagcgtgaaggttttgct

SEQ ID NO: 1708 - protein, 119 aa, Neisseria gonorrhoeae
MRVFRVNRFVVTVFGGGIGSAVPHAACVGKQAQADGACVFRTGHREEQLGGDVGFFVAAVADFFAVFVIHFRAERAAFVAAHRTQAAAVEVFKEGDFFGSAVAARNADFAAEHQREGFA

SEQ ID NO: 1709 - DNA, 483 bp, Neisseria meningitidis
atgggtattgccggcgccgtaaatgttttgaaccctgccgccggtcgcggaactgctgttgtcgtcgtaggttttgccgtcccacacgctgcctgcgtcggcaaacaggctcaggcggacggtgcgcgcgtctttcgcgccgggcatcgggaagagcagctcggcggagacgttggcttttttgttgccgccgtagctgattttttcgccgtattcgtcatagactttcggaccgagcgtgccgctttcgtatccgcgcaccgaacccaggccgccgccgtagaagttttcaaagaaggggatttctttggttctgccgtagccgcccgcaatgccgacttcgccgccgagcatcagcgtgaaggttttgctcagggggaagaaccaggtttggttgtgggtggcggagtagtattgcagtttgctgccaggcagggcgatttcggcgttcacgcccgtcaggtagccgcgcgtcggccataa

SEQ ID NO: 1710 - protein, 160 aa, Neisseria meningitidis
MGIAGAVNVLNPAAGRGTAVVVVGFAVPHAACVGKQAQADGARVFRAGHREEQLGGDVGFFVAAVADFFAVFVIDFRTERAAFVSAHRTQAAAVEVFKEGDFFGSAVAARNADFAAEHQREGFAQGEEPGLVVGGGVVLQFAARQGDFGVHARQVAARRP

SEQ ID NO: 1711 - DNA, 483 bp, Neisseria meningitidis
atgggtattgccggcgccgtaaatgttttgaaccctgccgccggtcgcggaactgctgttgtcgtcgtaggttttgccgtcccacacgctgcctgcgtcggcaaacaggctcaggcggacggtgcgcgcgtctttcgcgccgggcatcgggaagagcagctcggcggagacgttggcttttttgttgccgccgtagctgattttttcgccgtattcgtcatacactttcggaccgagcgtgccgctttcgtatccgcgcaccgaacccaggccgccgccgtagaagttttcaaagaaggggatttctttggttctgccgtagccgcccgcaatgccgacttcgccgccgagcatcagcgtgaaggttttgcttaaggggaagaaccaggtttggttgtgggtggcggagtagtattgcagtttgctgccgggcagggcgatttcggcgttcacgcccgtcaggtagccgcgcgtcggccataa

SEQ ID NO: 1712 - protein, 159 aa, Neisseria meningitidis
MGIAGAVNVLNPAAGRGTAVVVVGFAVPHAACVGKQAQADGARVFRAGHREEQLGGDVGFFVAAVADFFAVFVIHFRTERAAFVSAHRTQAAAVEVFKEGDFFGSAVAARNADFAAEHQREGFAGEEPGLVVGGGVVLQFAAGQGDFGVHARQVAARRP

SEQ ID NO: 1713 - DNA, 888 bp, Neisseria gonorrhoeae
atgtgcgccatcgtcggggcggcggggctgccttccgcgctcgcagcggcgcaaaaaggcaaaaccatttatctggcaaacaaagaaacgctggtggtttccggcgcgttgtttatggaaaccgcccgcgcaaacggcgcggcagtgttgcccgtcgacagcgaacacaacgccattttccaagttttgccgcgcgattacacagaccgtctgaacgaacacggcatcgattcgattatcctgaccgcttccggcggcccgtttttaacaaccgatttaagcacgttcgacagcattacgcccgagcaggcggtcaaacaccccaattggcgtatggggcgcaaaatctccgtcgattcagccactatggcaaacaagggcttggaactgattgaagcgcattggctgttcaactgtccgcccgacaaactcgaagtcgtcatccatccccaatccgtgatacacagtatggtgcgctaccgcgacggctccgtgctggcgcaactgggcaatcccgatatgcgaacgcccatcgcctattgtttgggcttgcccgagcgcatcgattcgggtgtcggcaaactcgatttcggcgcattgtccgcgctgaccttccaaaagcccgacttcggccgcttcccctgcctgaagttcgcctatgaaaccataaacgcaggcggagccgcgccctgcgtattgaacgccgccaacgaaaccgccgtcgccgcctttttggacggacagattaagtttaccgacattgccaaaaccgtcgcccactgtcttgcacaagacttttcaaacggcatgggcgatatagaaggactgttggcgcaagatgcccggacacgcgcacaagcgcgggcatttatcggcacactgcgctga

SEQ ID NO: 1714 - protein, 250 aa, Neisseria gonorrhoeae
MCAIVGAAGLPSALAAAQKGKTIYLANKETLVVSGALFMETARANGAAVLPVDSEHNAIFQVLPRDYTDRLNEHGIDSIILTASGGPFLTTDLSTFDSITPEQAVKHPNWRMGRKISVDSATMANKGLELIEAHWLFNCPPDKLEVVIHPQSVIHSMVRYRDGSVLAQLGNPDMRTPIAYCLGLPERIDSGVGKLDFGALSALTFQKPDFGRFPCLKFAYETINAGGAAPCVLNAANETAVAAFLDGQIK

SEQ ID NO: 1715 - DNA, 888 bp, Neisseria meningitidis
atgtgcgccatcgtcggggcggtggggctgccttccgcgctcgcagcggcgcaaaaaggcaaaaccatttatctggcaaacaaagaaacgctggtggtttccggcgcgttgtttatggaaaccgcccgtgcaaacggcgcggcagtgctgcccgtcgacagcgaacacaacgccgttttccaagttttgccgcgcgattacgccggccgtctgaacgaacacggcatcgcttcgattatcctgaccgcttccggcggcccgtttctgaccgccgatttaaacacgttcgaccgcattacgcccgcccaagcggtcaaacaccccaattggcgtatgggacgcaaaatctccgtcgattccgccaccatgatgaacaaaggtttggagctgattgaagcgcattggctgttcaactgtccgcccgacaaactcgaagtcgtcatccatccgcaatccgtgatacacagcatggtgcgctaccgcgacggctccgtgctggcgcaactgggcaatcccgatatgcgaacgcccatcgcttattgtttgggtttgcccgagcgcatcgattcgggtgtcggcgacctggatttcgacgcattgtccgcgctgaccttccaaaagcccgactttgaccgcttcccctgcctgaggctcgcctatgaagccatgaacgcaggcggagccgcgccctgcgtattgaacgccgccaacgaagccgccgtcgccgcctttttggacggacagattaagtttaccgacattgccaaaaccgtcgcccactgtcttgcacaagacttttcagacggcataggcgatataggggggctcttggcgcaagatgcccggacacgcgcacaagcgcgagcatttatcggcacactgcgctga

SEQ ID NO: 1716 - protein, 295 aa, Neisseria meningitidis
MCAIVGAVGLPSALAAAQKGKTIYLANKETLVVSGALFMETARANGAAVLPVDSEHNAVFQVLPRDYAGRLNEHGIASIILTASGGPFLTADLNTFDRITPAQAVKHPNWRMGRKISVDSATMMNKGLELIEAHWLFNCPPDKLEVVIHPQSVIHSMVRYRDGSVLAQLGNPDMRTPIAYCLGLPERIDSGVGDLDFDALSALTFQKPDFDRFPCLRLAYEAMNAGGAAPCVLNAANEAAVAAFLDGQIKFTDIAKTVAHCLAQDFSDGIGDIGGLLAQDARTRAQARAFIGTLR

SEQ ID NO: 1717 - DNA, 888 bp, Neisseria meningitidis
atgtgcgccatcgtcggggcggtggggctgccttccgcgctcgcagcggcgcaaaaaggcaaaaccatttatctggcgaacaaagagacgctggtggtttccggcgcgttgtttatggaaaccgcccgtgcaaacggcgcggcagtgctgcccgtcgacagcgaacacaacgccgttttccaagttttgccgcgcgattacacaggtcgcctgaacgaacacggcatcgcttcgattatcctgaccgcttccggcggcccgtttctgaccgccgatttaaacacgttcgacagcattacgcccgaccaagcggtcaaacaccccaattggcgtatgggacgcaaaatctccgtcgattccgccaccatgatgaacaaaggtttggagctgattgaagcgcattggctgttcaactgtccgcccgacaaactcgaagtcgtcatccatccgcaatctgtgatacacagcatggtgcgctaccgcgacggctccgtgttggcgcaactgggcaatcccgatatgcgaacgcctatcgcttattgtttgggtttgcccgagcgcatcgattcgggtgtcggcgacctggatttcgacgcattgtccgcgctgaccttccaaaagcccgactttgaccgcttcccctgcctgaagctcgcctatgaagccatgaacgcaggcggagccgcgccctgcgtattgaacgccgccaacgaagccgccgtcgccgcctttttggacggacagattaagtttaccgacattgccaaaaccgtcgcccattgtctttcacaagacttttcagacggcataggcgacataggggggctcttggcgcaagatgcccggacacgcgcacaagcgcgggcatttatcggcacactgcgctga

SEQ ID NO: 1718 - protein, 295 aa, Neisseria meningitidis
MCAIVGAVGLPSALAAAQKGKTIYLANKETLVVSGALFMETARANGAAVLPVDSEHNAVFQVLPRDYTGRLNEHGIASIILTASGGPFLTADLNTFDSITPDQAVKHPNWRMGRKISVDSATMMNKGLELIEAHWLFNCPPDKLEVVIHPQSVIHSMVRYRDGSVLAQLGNPDMRTPIAYCLGLPERIDSGVGDLDFDALSALTFQKPDFDRFPCLKLAYEAMNAGGAAPCVLNAANEAAVAAFLDGQIKFTDIAKTVAHCLSQDFSDGIGDIGGLLAQDARTRAQARAFIGTLR

SEQ ID NO: 1719 - DNA, 1095 bp, Neisseria gonorrhoeae
atgccctgtttgtgccgccttaatcgcaatatcggcagtttccaaatcacgaatctcaccgaccataatgatgtccgggtcctgacgcaggaaagacttcaaagcagcggcaaaagtcagaccctgcttatcattgacgttaacctgattgatgcccggcaggttaatctcggcagggtcttccgccgttgcaatatttaccgactccgtattcaaaatattcaaacaggtatagagcgacaccgtcttacccgaacccgtcggaccggttaccagcaccatcccgtaaggacggtgaatcgcttccaacaacaattttttctggaacggctcaaaaccgagctggtcgatgttcaaagacgcggcatcggaattcaaaatccgcatcacgaccttttcgccaaacagcgtcggcaatgtgctgacacggaaatcgacaggcttgccgcccttttgaaaggtcagctgcatcctaccgtcctgcggtatccgtttttcggaaatgtccaaacgcgacattaccttaatccgggaagcaagctgcccccttaccgcaatgggcggctgaaccacctcgcggagctgcccgtccacacggaaacggatacgcgcattgtgttcgtaaaactcgaaatggatgtcggatgccccgctacgcaaggcatccgacaaagttttatggataaacctcggaacagggccgtcttctgcctcctcgtcgtcgatatacagggtgtggctttcctcttcctcttgcccctccccaagctcctgaagcagcgatgtcgaacgcgaacccacccaatcgagcaaacccgccaactggtcatcctcgacaatgaccaactcaaccgcaatccctgcggcagaaaccgttttctgaatttgcggcatctgggtcggatcggaaaccgcaaaaaatactttgtcgcccccacggaaaaccggcacacagtggaactccaccatctgctcctccgtcaacacccccatcagcaccctgtggcgcggataatgacgcaaatcaagaatcgaataactgaacaccctcgcaatcaatgccgcaagcgacttgggcgaaatgacaccgtctga

SEQ ID NO: 1720 - protein, 364 aa, Neisseria gonorrhoeae
MPCLCRLNRNIGSFQITNLTDHNDVRVLTQERLQSSGKSQTLLIIDVNLIDARQVNLGRVFRRCNIYRLRIQNIQTGIERHRLTRTRRTGYQHHPVRTVNRFQQQFFLERLKTELVDVQRRGIGIQNPHHDLFAKQRRQCADTEIDRLAALLKGQLHPTVLRYPFFGNVQTRHYLNPGSKLPPYRNGRLNHLAELPVHTETDTRIVFVKLEMDVGCPATQGIRQSFMDKPRNRAVFCLLVVDIQGVAFLFLLPLPKLLKQRCRTRTHPIEQTRQLVILDNDQLNRNPCGRNRFLNLRHLGRIGNRKKYFVAPTENRHTVELHHLLLRQHPHQHPVARIMTQIKNRITEHPRNQCRKRLGRNDTV

SEQ ID NO: 1721 - DNA, 1094 bp, Neisseria meningitidis
atgccctgtttgtgccgccttaatcgcaatatcggcagtttccaaatcacgaatctcaccgaccataatgatgtccgggtcctgacgcaggaaagacttcaaagcagcggcaaaagtcaggccctgcttatcattgacgttaacctgattgatgcccggcaggttaatctcggcagggtcttccgccgttgcaatatttaccgactccgtattcaaaatattcaaacaggtatagagcgacaccgtcttacccgaacccgtcggaccggttaccagcaccatcccgtagggacggtgaatcgctaccaacacawttttttctgaaacggctcaaaaccgagctggtcgatgttcaaagacgcggcatcggaattcaaaatccgcatcacgaccttttcgccaaacagcgtcggcaatgtgctgacacggaaatcgacaggcttgccgcccttttgaaaggtcagctgcatcctgccgtcctgcggtatccgtttttcggaaatgtccaaacgcgacattaccttaatccgtgaagcaagctgcccccttaccgcaatgggcggctgaaccacctcgcggagctgcccgtccacacggaaacggatacgggcattgtgttcgtaaaactcgaaatggatgtccgatgccccgctgcgcaaggcatccgacaaagtcttatggataaacctcggaacagggccgtcttctgcctcctcgttgtcgatatacagggtgtggctttcctcttcctcctgcccctccccaagctcctgaagcagcgatgtcgaacgcgaacccacccaatcgagcaaacccgccaactggtcatcctcgacaatgaccaactcaacctcaatccctgcggcagaaacggttttctgaatttgcggcatctgtgtcggatcggaaaccgcaaaaaatactttgtcgccccgacggaaaaccggcacacagtggaactccaccatctgctcctccgtcaacacccccatcagcaccctgtggcgcggataatgacgcaaatcaagaatcgaataactgaacaccctcgcaatcaatgccgcaagcgacttgggcgaaatgacaccgtctga

SEQ ID NO: 1722 - protein, 363 aa, Neisseria meningitidis
  misc_feature (105)..(105): Xaa can be any naturally occurring amino acid
MPCLCRLNRNIGSFQITNLTDHNDVRVLTQERLQSSGKSQALLIIDVNLIDARQVNLGRVFRRCNIYRLRIQNIQTGIERHRLTRTRRTGYQHHPVGTVNRYQHXFFLKRLKTELVDVQRRGIGIQNPHHDLFAKQRRQCADTEIDRLAALLKGQLHPAVLRYPFFGNVQTRHYLNPSKLPPYRNGRLNHLAELPVHTETDTGIVFVKLEMDVRCPAAQGIRQSLMDKPRNRAVFCLLVVDIQGVAFLFLLPLPKLLKQRCRTRTHPIEQTRQLVILDNDQLNLNPCGRNGFLNLRHLCRIGNRKKYFVAPTENRHTVELHHLLLRQHPHQHPVARIMTQIKNRITEHPRNQCRKRLGRNDTV

SEQ ID NO: 1723 - DNA, 1095 bp, Neisseria meningitidis
atgccctgtttgtgccgccttaatcgcaatatcggcagtttccaaatcacgaatctcaccgaccataatgatgtccgggtcctgacgcaggaaagacttcaaagcagcggcaaaagtcagaccctgcttatcattgacgttaacctgattgatgcccggcaggttaatctcggcagggtcttccgccgttgcaatatttaccgactccgtattcaaaatattcaaacaggtatagagcgacaccgtcttacccgaacccgtcggaccggttaccagcaccatcccgtagggacggtgaatcgcttccaacaacaattttttctgaaacggctcaaaaccgagctggtcgatgttcaaagacgcggcatcggaattcaaaatccgcatcacgaccttttcgccaaacagcgtcggcaatgtgctgacacggaaatcgacaggcttgccgcccttttgaaaggtcagctgcatcctgccgtcctgcggtatccgtttttcggaaatgtccaaacgcgacattaccttaatccgggaagcaagctgcccccttaccgcaatgggcggctgaaccacctcgcggagctgcccgtccacacggaaacggatacgggcattgtgttcgtaaaactcgaaatggatgtccgatgccccgctgcgcaaggcatccgacaaagtcttatggataaacctcggaacagggccgtcttctgcctcctcgttgtcgatatacagggtgtggctttcctcttcctcctgcccctccccaagctcctgaagcagcgatgtcgaacgcgaacccacccaatcgagcaaacccgccaactggtcatcctcgacaatgaccaactcaacctcaatccctgcggcagaaacggttttctgaatttgcggcatctgtgtcggatcggaaaccgcaaaaaatactttgtcgccccgacggaaaaccggcacacagtggaactccaccatctgctcctccgtcaacacccccatcagcaccctgtggcgcggataatgacgcaaatcaagaatcgaataactgaacaccctcgcaatcaatgccgcaagcgacttgggcgaaatgacaccgtctga

SEQ ID NO: 1724 - protein, 364 aa, Neisseria meningitidis
MPCLCRLNRNIGSFQITNLTDHNDVRVLTQERLQSSGKSQTLLIIDVNLIDARQVNLGRVFRRCNIYRLRIQNIQTGIERHRLTRTRRTGYQHHPVGTVNRFQQQFFLKRLKTELVDVQRRGIGIQNPHHDLFAKQRRQCADTEIDRLAALLKGQLHPAVLRYPFFGNVQTRHYLNPGSKLPPYRNGRLNHLAELPVHTETDTGIVFVKLEMDVRCPAAQGIRQSLMDKPRNRAVFCLLVVDIQGVAFLFLLPLPKLLKQRCRTRTHPIEQTRQLVILDNDQLNLNPCGRNGFLNLRHLCRIGNRKKYFVAPTENRHTVELHHLLLRQHPHQHPVARIMTQIKNRITEHPRNQCRKRLGRNDTV

SEQ ID NO: 1725 - DNA, 1209 bp, Neisseria gonorrhoeae
atgctgccgaatctgccaaacagccttaagaaagccgatatggacaacgaattgtggattatcctgctgccgattatccttttgcccgtcttcttcacgatgggctggtttgccgcccgcgtggatatgaaaaccgtattgaagcaggcaaaaagcatcccttcgggattttataaaagcctggacgctttggtcgaccgcaacagcgggcgcgcggcaagggagttggcggaagtcgtcgacggccggccgcaatcgtatgatttgaaccttaccctcggcaaactttaccgtcagcgcggcgaaaacgacaaagccatcaacatacaccggacaatgctcgattctcccgatacggtcggcgaaaagcgcgcgcgcgtcctgtttgaattggcgcaaaactaccaaagcgcgggtttggtcgatcgtgccgaacagatttttttggggctgcaagacggtgaaatggcgcgtgaagccagacagcacctgctcaatatctaccagcaggacagggattgggaaaaagcggttgaaaccgcccaacttcttagtcacgacgaacagacatatcagtttgagattgcacagttttattgcgaacttgcccaagccgcgctgttcaagtccaatttcgatgccgcgcgtttcaatgtcggcaaggcactcgaagccaacaaaaaatgcacccgcgccaacatgattttgggcgacattgaacaccgacaaggcaatttccctgccgccgtcgaagcctatgccgccatcgagcagcaaaaccatgcatacttgagcatggtcggcgagaagctttacgaagcctatgccgcgcagggaaaacctgaagaaggcttgaaccgtctgacaggatatatgcagacgtttcccgaacttgacctgatcaatgtcgtgtacgagaaatccctgctgcttaagggcgagaaagaagccgcgcaaaccgccgtcgagcttgtccgccgcaagcccgaccttaacggcgtgtaccgcctgctcggtttgaaactcagcgatttggatccggcttggaaagccgatgccgacatgatgcgttcggttatcggacggcagctccagcgcagcgtgatgtaccgttgccgcaactgccacttcaaatcccaagtctttttctggcactgtcccgcctgcaacaaatggcagacgtttacgccgaataaaatcgaagtttaa

SEQ ID NO: 1726 - protein, 402 aa, Neisseria gonorrhoeae
MLPNLPNSLKKADMDNELWIILLPIILLPVFFTMGWFAARVDMKTVLKQAKSIPSGFYKSLDALVDRNSGRAARELAEVVDGRPQSYDLNLTLGKLYRQRGENDKAINIHRTMLDSPDTVGEKRARVLFELAQNYQSAGLVDRAEQIFLGLQDGEMAREARQHLLNIYQQDRDWEKAVETAQLLSHDEQTYQFEIAQFYCELAQAALFKSNFDAARFNVGKALEANKKCTRANMILGDIEHRQGNFPAAVEAYAAIEQQNHAYLSMVGEKLYEAYAAQGKPEEGLNRLTGYMQTFPELDLINVVYEKSLLLKGEKEAAQTAVELVRRKPDLNGVYRLLGLKLSDLDPAWKADADMMRSVIGRQLQRSVMYRCRNCHFKSQVFFWHCPACNKWQTFTPNKIEV

SEQ ID NO: 1727 - DNA, 1209 bp, Neisseria meningitidis
atgcgcccgaatctaccaaacagccttaagaaagccgatatggacaacgaattgtggattatcctgctgccgattatccttttgcccgtcttcttcgcgatgggctggtttgccgcccgcgtggatatgaaaaccgtattgaagcaggcaaaaagcatcccttcgggattttataaaagcttggacgctttggtcgaccgcaacagcgggcgcgcggcaagggagttggcggaagtcgtcgacggccggccgcaatcgtatgatttgaacctcaccctcggcaaactttaccgccagcgtggcgaaaacgacaaagccatcaacatacaccggacaatgctcgattctcccgatacggtcggcgaaaagcgcgcgcgcgtcctgtttgaattggcgcaaaactaccaaagtgcggggttggtcgatcgtgccgaacagatttttttggggctgcaagacggtaaaatggcgcgtgaagccagacagcacctgctcaatatctaccaacaggacagggattgggaaaaagcggttgaaaccgcccggctgctcagccatgacgatcagacctatcagtttgaaatcgcccagttttattgcgaacttgcccaagccgcgctgttcaagtccaatttcgatgtcgcgcgtttcaatgtcggcaaggcactcgaagccaacaaaaaatgcacccgcgccaacatgattttgggcgacatcgaacaccgacaaggcaatttccctgccgccgtcgaagcctatgccgccatcgagcagcaaaaccatgcatacttgagcatggtcggcgagaagctttacgaagcctatgccgcgcagggaaaacctgaagaaggcttgaaccgtctgacaggatatatgcagacgtttcccgaacttgacctgatcaatgtcgtgtacgagaaatccctgctgcttaagtgcgagaaagaagccgcgcaaaccgccgtcgagcttgtccgccgcaagcccgaccttaacggcgtgtaccgcctgctcggtttgaaactcagcgatatgaatccggcttggaaagccgatgccgacatgatgcgttcggttatcggacggcagctacagcgcagcgtgatgtaccgttgccgcaactgccacttcaaatcccaagtctttttctggcactgccccgcctgcaacaaatggcagacgtttaccccgaataaaatcgaagtttaa

SEQ ID NO: 1728 - protein, 402 aa, Neisseria meningitidis
MRPNLPNSLKKADMDNELWIILLPIILLPVFFAMGWFAARVDMKTVLKQAKSIPSGFYKSLDALVDRNSGRAARELAEVVDGRPQSYDLNLTLGKLYRQRGENDKAINIHRTMLDSPDTVGEKRARVLFELAQNYQSAGLVDRAEQIFLGLQDGKMAREARQHLLNIYQQDRDWEKAVETARLLSHDDQTYQFEIAQFYCELAQAALFKSNFDVARFNVGKALEANKKCTRANMILGDIEHRQGNFPAAVEAYAAIEQQNHAYLSMVGEKLYEAYAAQGKPEEGLNRLTGYMQTFPELDLINVVYEKSLLLKCEKEAAQTAVELVRRKPDLNGVYRLLGLKLSDMNPAWKADADMMRSVIGRQLQRSVMYRCRNCHFKSQVFFWHCPACNKWQTFTPNKIEV

SEQ ID NO: 1729 - DNA, 1209 bp, Neisseria meningitidis
atgcgcccgaatctgccaaacagccttgagaaagccgatatggacaatgaattgtggattatcctgctgccgattatccttttgcccgttttcttcgcgatgggctggtttgccgcccgcgtggatatgaagactgtattaaagcaggcaaaaagcataccgtcgggattttataaaagtctggatgccttggttgaccgcaacagcgggcgcgcggcaagggagttggcggaagtcgtcgacggccggccgcaatcgtatgatttgaacctcaccctcggcaaactttaccgccagcgtggcgaaaacgacaaagccatcaatatgcaccaaacattgcttgactctcccgatacaaccggagccaagcgcgcgcgcgtcctgtttgaattggcgcaaaactaccaaagtgcggggttggtcgatcgtgccgaacagatttttttggggctgcaagacggtgaaatggcgcgtgaagccagacagcacctgctcaatatctaccaacaggacagggattgggaaaaagcggttgaaaccgcccggctgctcagccatgacgatcagacctatcagtttgaaatcgcccagttttattgcgaacttgcccaagccgcgctgttcaagtccaatttcgatgccgcgcgtttcaatgtcggcaaggcactcgaagccaacaaaaaatgcacccgcgccaacatgattttgggcgacatcgaacaccgacaaggcaatttccctgccgccgtcgaagcctatgccgccatcgagcagcaaaaccatgcatacttgagtatggtcggcgagaagctttacgaagcctatgccgcgcagggaaaacctgaagaaggcttgaaccgtctgacaggatatatgcagacgtttcccgaacttgacctgatcaatgtcgtgtacgagaaatccctgctgcttaagtgcgagaaagaagccgcgcaaaccgccgtcgagcttgtccgccgcaagcccgacctcaacggcgtgtaccgcctgcttggtttgaaactcagcgatttggatccggcttggaaagccgatgccgatatgatgcgttcggttatcggacggcagctacagcgcagcgtgatgtaccggtgccgaaactgccacttcaaatcacaagtctttttctggcattgtcctgcctgcaacaaatggcagacgtttacgccaaacaaaatcgaagtttaa

SEQ ID NO: 1730 - protein, 402 aa, Neisseria meningitidis
MRPNLPNSLEKADMDNELWIILLPIILLPVFFAMGWFAARVDMKTVLKQAKSIPSGFYKSLDALVDRNSGRAARELAEVVDGRPQSYDLNLTLGKLYRQRGENDKAINMHQTLLDSPDTTGAKRARVLFELAQNYQSAGLVDRAEQIFLGLQDGEMAREARQHLLNIYQQDRDWEKAVETARLLSHDDQTYQFEIAQFYCELAQAALFKSNFDAARFNVGKALEANKKCTRANMILGDIEHRQGNFPAAVEAYAAIEQQNHAYLSMVGEKLYEAYAAQGKPEEGLNRLTGYMQTFPELDLINVVYEKSLLLKCEKEAAQTAVELVRRKPDLNGVYRLLGLKLSDLDPAWKADADMMRSVIGRQLQRSVMYRCRNCHFKSQVFFWHCPACNKWQTFTPNKIEV

SEQ ID NO: 1731 - DNA, 561 bp, Neisseria gonorrhoeae
atgccgtgcctccgccggcaagcagcaaggtgtacgaaccgccgaacagaccgtcaaacagtccgctttcggtttcttcttcggcagaaacctgttcgacaggttcggcaacgggttcggcggcaacttcactggctgtttccgcaacaggttcggaaacggtgttaccggtttcgtcggtcggcgtgtcgatggcagaagcggcggcttcttgggggggcggattcggcagcggtttccgatgcggcagtatttgcagcgggtacaggtccgggttggcgttctgtcgccgaagccggagtttcggacactgcgggtttgggttcgggtcgaacggccggtttttccgcttttgcttcgggcgcggcaacttttgcttcaggtttttcaaccggtttttcgacaggtttctctatcggtttctccacagttgcctgtttggacggttcagacggcatggatgcagtttcggctttgggtttcgccgtttgcggtttgggttgttccgctttgatttttttgggtgctgccgctttgatcctgttcagattcggaatgtga

SEQ ID NO: 1732 - protein, 186 aa, Neisseria gonorrhoeae
MPCLRRQAARCTNRRTDRQTVRFRFLLRQKPVRQVRQRVRRQLHWLFPQQVRKRCYRFRRSACRWQKRRLLGGADSAAVSDAAVFAAGTGPGWRSVAEAGVSDTAGLGSGRTAGFSAFASGAATFASGFSTGFSTGFSIGFSTVACLDGSDGMDAVSALGFAVCGLGCSALIFLGAAALILFRFGM

SEQ ID NO: 1733 - DNA, 1035 bp, Neisseria meningitidis
atggtttcgggcgaggaagccttcaggaagcctgccagtccggagggtgaggcaggttttgcggaagctgtttcttctgtgccgatatggttgtttgagggcaggttgtcggagaaatcggtatcgacggtttccggtttgttttcggcagtttgggcgacagattccggttcgggcgtgtcgatgacgatttcgacagggttgtacgggttgaaggtctcgggctcgtacacgctgtctgtggattcgatggcgttccaatcggcatccgcgcgtttttgggtttcttcatcctgcgtaagtgcgccggataaaatgccgttttgcgcggctgccaggctgtcgaaatccaagtcgatgcggttggaaggcgtatcggtttcgacatcgaacgtttgttttgccgataactcttcttcagattccccatctaaggcaagtgtgtcgtttacatcgtttttcggagcgggttcgggcgttgccggagtttcgacttcggcaaaggtgatttctatgccgtcgtctgccgcgtcgtcaaggtcaggctcttcctcagggacggattcttcggtacggcgcgcgcgtttggattgggcaaggcgcaaaagcagcagcagggcgattaatgccgcgcctccgccggcaagcagcaaggtgtacgaaccgccgaacagaccgtcaaacagtccgctttcggtttcttcttcggcagaaacctgttcgacaggttcggaaacggcgttaccggtttcgtcggtcggcgtgtcgatggcagaagcggcggcttcttggggggcggattcggcagcggtttccgatgcggcagtatttgcagcgggtacaggttcgggtcgaacggccggtttttccgcttttgcttcgggcgcggcaacttttgcttcaggtttttcaaccggtttctctaccgttgcctgtttggacggttcggacggcatggatgcggtttcggctttgggtttcgccgtttgcggtttgggttgttccgctttgatcctgttcagattcggaatgtga

SEQ ID NO: 1734 - protein, 344 aa, Neisseria meningitidis
MVSGEEAFRKPASPEGEAGFAEAVSSVPIWLFEGRLSEKSVSTVSGLFSAVWATDSGSGVSMTISTGLYGLKVSGSYTLSVDSMAFQSASARFWVSSSCVSAPDKMPFCAAARLSKSKSMRLEGVSVSTSNVCFADNSSSDSPSKASVSFTSFFGAGSGVAGVSTSAKVISMPSSAASSRSGSSSGTDSSVRRARLDWARRKSSSRAINAAPPPASSKVYEPPNRPSNSPLSVSSSAETCSTGSETALPVSSVGVSMAEAAASWGADSAAVSDAAVFAAGTGSGRTAGFSAFASGAATFASGFSTGFSTVACLDGSDGMDAVSALGFAVCGLGCSALILFRFGM

SEQ ID NO: 1735 - DNA, 1023 bp, Neisseria meningitidis
atggtttcgggcgaggaagccttcaggaagcctgccagtccggagggtgaggcaggttttgcggaagctgtttcttctgtgccgatatggttgtttgagggcaggttgtcggagaaatcggtatcgacggtttccggtttgttttcggcagtttgggcgacagattccggttcgggcgtgtcgatgacgatttcgacagggttgtacgggttgaaggtctcgggctcgtacacgctgtctgtggattcgatggcgttccaatcggcatccgcgcgtttttgggtttcttcatcctgcgtaagtgcgccggataaaatgccgttttgcgcggctgccaggctgtcgaaatccaagtcgatgcggttggaaggcgtatcggtttcgacatcgaacgtttgttttgccgacaactcttcttcagattccccatctaaggcaagtgtgtcgtttacatcgtttttcggagcgggttcgggcgttgccggagtttcgacttcggcaaaggtgatttctatgccgtcgtctgccgcgtcgtcaaggtcaggctcttcctcagggacggattcttcggtacggcgcgcgcgtttggattgggcaaggcgcaaaagcagcagcagggcgatcaatgccgcgcctccgccggcaagcagcaaggtgtacgaaccgccgaacagtccgctttcggtttcttcttcggcagaaacctgttcgacaggttcggaaacggcgttaccggtttcgtcggtcggcgtgtcgatggcagaagcggcggcttcttggggggcggattcggcagcggtttccgatgcggcagtatttgcagcgggtacaggttcgggtcgaacggccggtttttccgcttttgcttcgggcgcggcaacttttgcttcaggtttttcaaccggtttctctaccgttgcctgtttggacggttcggacggcatggatgcggtttcggctttgggtttcgccgtttgcggtttgggttgttccgctttgatcctgttcagattcggaatgtga

SEQ ID NO: 1736 - protein, 340 aa, Neisseria meningitidis
MVSGEEAFRKPASPEGEAGFAEAVSSVPIWLFEGRLSEKSVSTVSGLFSAVWATDSGSGVSMTISTGLYGLKVSGSYTLSVDSMAFQSASARFWVSSSCVSAPDKMPFCAAARLSKSKSMRLEGVSVSTSNVCFADNSSSDSPSKASVSFTSFFGAGSGVAGVSTSAKVISMPSSAASSRSGSSSGTDSSVRRARLDWARRKSSSRAINAAPPPASSKVYEPPNSPLSVSSSAETCSTGSETALPVSSVGVSMAEAAASWGADSAAVSDAAVFAAGTGSGRTAGFSAFASGAATFASGFSTGFSTVACLDGSDGMDAVSALGFAVCGLGCSALILFRFGM

SEQ ID NO: 1737 - DNA, 648 bp, Neisseria gonorrhoeae
atgggcgtggacatcggacgctccctgaaacaaatgaaggaacagggcgcggaaatcgatttgaaagtctttaccgatgccatgcaggcagtgtatgacggcaaagaaatcaaaatgaccgaagagcaggcccaggaagtgatgatgaaattcctgcaggagcagcaggctaaagccgtagaaaaacacaaggcggatgcgaaggccaacaaagaaaaaggcgaagccttcctgaaggaaaatgccgccgaagacggcgtgaagaccactgcttccggtctgcagtacaaaatcaccaaacagggtgaaggcaaacagccgacaaaagacgacatcgttaccgtggaatacgaaggccgcctgattgacggtaccgtattcgacagcagcaaagccaacggcggcccggccaccttccctttgagccaagtgattccgggttggaccgaaggcgtacggcttctgaaagaaggcggcgaagccacgttctacatcccgtccaaccttgcctaccgcgaacagggtgcgggcgaaaaaatcggtccgaacgccactttggtatttgacgtgaaactggtcaaaatcggcgcacccgaaaacgcgcccgccaagcagccggatcaagtcgacatcaaaaaagtaaattaa

SEQ ID NO: 1738 - protein, 215 aa, Neisseria gonorrhoeae
MGVDIGRSLKQMKEQGAEIDLKVFTDAMQAVYDGKEIKMTEEQAQEVMMKFLQEQQAKAVEKHKADAKANKEKGEAFLKENAAEDGVKTTASGLQYKITKQGEGKQPTKDDIVTVEYEGRLIDGTVFDSSKANGGPATFPLSQVIPGWTEGVRLLKEGGEATFYIPSNLAYREQGAGEKIGPNATLVFDVKLVKIGAPENAPAKQPDQVDIKKVN

SEQ ID NO: 1739 - DNA, 669 bp, Neisseria meningitidis
atgcagcaggcaagctatgcgatgggcgtggacatcggacgctccctgaagcaaatgaaggaacagggcgcggaaatcgatttgaaagtctttaccgaagccatgcaggcagtgtatgacggcaaagaaatcaaaatgaccgaagagcaggctcaggaagtcatgatgaaattccttcaggaacaacaggctaaagccgtagaaaaacacaaggcggacgcgaaggccaataaagaaaaaggcgaagcctttctgaaagaaaatgccgccaaagacggcgtgaagaccactgcttccggcctgcaatacaaaatcaccaaacagggcgaaggcaaacagccgaccaaagacgacatcgttaccgtggaatacgaaggccgcctgattgacggtacggtattcgacagcagcaaagccaacggcggcccggtcaccttccctttgagccaagtgattccgggttggaccgaaggcgtacagcttctgaaagaaggcggcgaagccacgttctacatcccgtccaaccttgcctaccgcgaacagggtgcgggcgacaaaatcggtccgaacgccactttggtatttgatgtgaaactggtcaaaatcggcgcacccgaaaacgcgcccgccaagcagccggctcaagtcgacatcaaaaaagtaaattaa

SEQ ID NO: 1740 - protein, 222 aa, Neisseria meningitidis
MQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPVTFPLSQVIPGWTEGVQLLKEGGEATFYIPSNLAYREQGAGDKIGPNATLVFDVKLVKIGAPENAPAKQPAQVDIKKVN

SEQ ID NO: 1741 - DNA, 819 bp, Neisseria meningitidis
atgaacaccattttcaaaatcagcgcactgaccctttccgccgctttggcactttccgcctgcggcaaaaaagaagccgcccccgcatctgcatccgaacctgccgccgcttcttccgcgcagggcgacacctcttcgatcggcagcacgatgcagcaggcaagctatgcgatgggcgtggacatcggacgctccctgaagcaaatgaaggaacagggcgcggaaatcgatttgaaagtctttaccgaagccatgcaggcagtgtatgacggcaaagaaatcaaaatgaccgaagagcaggctcaggaagtcatgatgaaattccttcaggaacaacaggctaaagccgtagaaaaacacaaggcggacgcgaaggccaataaagaaaaaggcgaagcctttctgaaagaaaatgccgccaaagacggcgtgaagaccactgcttccggcctgcaatacaaaatcaccaaacagggcgaaggcaaacagccgaccaaagacgacatcgttaccgtggaatacgaaggccgcctgattgacggtacggtattcgacagcagcaaagccaacggcggcccggtcaccttccctttgagccaagtgattctgggttggaccgaaggcgtacagcttctgaaagaaggcggcgaagccacgttctacatcccgtccaaccttgcctaccgcgaacagggtgcgggcgacaaaatcggcccgaacgccactttggtatttgatgtgaaactggtcaaaatcggcgcacccgaaaacgcgcccgccaagcagccggctcaagtcgacatcaaaaaagtaaattaa

SEQ ID NO: 1742 - protein, 272 aa, Neisseria meningitidis
MNTIFKISALTLSAALALSACGKKEAAPASASEPAAASSAQGDTSSIGSTMQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPVTFPLSQVILGWTEGVQLLKEGGEATFYIPSNLAYREQGAGDKIGPNATLVFDVKLVKIGAPENAPAKQPAQVDIKKVN

SEQ ID NO: 1743 - DNA, 819 bp, Neisseria gonorrhoeae
atgaacaccattttcaaaatcagcgcactgaccctttccgccgctttggcactttccgcctgcggcaaaaaagaagccgcccccgcatctgcatccgaacctgccgccgcttctgccgcgcagggcgacacctcttcaatcggcagcacgatgcagcaggcaagctatgcaatgggcgtggacatcggacgctccctgaaacaaatgaaggaacagggcgcggaaatcgatttgaaagtctttaccgatgccatgcaggcagtgtatgacggcaaagaaatcaaaatgaccgaagagcaggcccaggaagtgatgatgaaattcctgcaggagcagcaggctaaagccgtagaaaaacacaaggcggatgcgaaggccaacaaagaaaaaggcgaagccttcctgaaggaaaatgccgccaaagacggcgtgaagaccactgcttccggtctgcagtacaaaatcaccaaacagggtgaaggcaaacagccgacaaaagacgacatcgttaccgtggaatacgaaggccgcctgattgacggtaccgtattcgacagcagcaaagccaacggcggcccggccaccttccctttgagccaagtgattccgggttggaccgaaggcgtacggcttctgaaagaaggcggcgaagccacgttctacatcccgtccaaccttgcctaccgcgaacagggtgcgggcgaaaaaatcggtccgaacgccactttggtatttgacgtgaaactggtcaaaatcggcgcacccgaaaacgcgcccgccaagcagccggatcaagtcgacatcaaaaaagtaaattaa

SEQ ID NO: 1744 - protein, 272 aa, Neisseria gonorrhoeae
MNTIFKISALTLSAALALSACGKKEAAPASASEPAAASAAQGDTSSIGSTMQQASYAMGVDIGRSLKQMKEQGAEIDLKVFTDAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPATFPLSQVIPGWTEGVRLLKEGGEATFYIPSNLAYREQGAGEKIGPNATLVFDVKLVKIGAPENAPAKQPDQVDIKKVN

SEQ ID NO: 1745 - DNA, 819 bp, Neisseria meningitidis
atgaacaccattttcaaaatcagcgcactgaccctttccgccgctttggcactttccgcctgcggcaaaaaagaagccgcccccgcatctgcatccgaacctgccgccgcttcttccgcgcagggcgacacctcttcgatcggcagcacgatgcagcaggcaagctatgcgatgggcgtggacatcggacgctccctgaagcaaatgaaggaacagggcgcggaaatcgatttgaaagtctttaccgaagccatgcaggcagtgtatgacggcaaagaaatcaaaatgaccgaagagcaggctcaggaagtcatgatgaaattccttcaggaacaacaggctaaagccgtagaaaaacacaaggcggacgcgaaggccaataaagaaaaaggcgaagcctttctgaaagaaaatgccgccaaagacggcgtgaagaccactgcttccggcctgcaatacaaaatcaccaaacagggcgaaggcaaacagccgaccaaagacgacatcgttaccgtggaatacgaaggccgcctgattgacggtacggtattcgacagcagcaaagccaacggcggcccggtcaccttccctttgagccaagtgattccgggttggaccgaaggcgtacagcttctgaaagaaggcggcgaagccacgttctacatcccgtccaaccttgcctaccgcgaacagggtgcgggcgacaaaatcggtccgaacgccactttggtatttgatgtgaaactggtcaaaatcggcgcacccgaaaacgcgcccgccaagcagccggctcaagtcgacatcaaaaaagtaaattaa

SEQ ID NO: 1746 - protein, 272 aa, Neisseria meningitidis
MNTIFKISALTLSAALALSACGKKEAAPASASEPAAASSAQGDTSSIGSTMQQASYAMGVDIGRSLKQMKEQGAEIDLKVFTEAMQAVYDGKEIKMTEEQAQEVMMKFLQEQQAKAVEKHKADAKANKEKGEAFLKENAAKDGVKTTASGLQYKITKQGEGKQPTKDDIVTVEYEGRLIDGTVFDSSKANGGPVTFPLSQVIPGWTEGVQLLKEGGEATFYIPSNLAYREQGAGDKIGPNATLVFDVKLVKIGAPENAPAKQPAQVDIKKVN

SEQ ID NO: 1747 - DNA, 819 bp, Neisseria meningitidis; identical to SEQ ID NO: 1741

SEQ ID NO: 1748 - protein, 272 aa, Neisseria meningitidis; identical to SEQ ID NO: 1742

SEQ ID NO: 1749 - DNA, 483 bp, Neisseria gonorrhoeae
atggaaaggagcggtgtatttggtaaaattgtcggcaatcgcatactccgtatgccgtccgaacacgctgccgcattctatccgaaaccgtgcaaatcgtttaaactaacgcaatcttggttcagagtgcgaagctgtccgtgcggcgtttttatttacggagcaaacatgaaacttatctataccgtcatcaaaatcattatcctgctgctcttcctgctgcttgccgtcattaatatggatgccgttaccttttcctatcttccggggcagagtgtcaatctgccgctgattgtcgtattgttcggcgcgtttgtcgtcggcatcgtgttcggaatgtttgccctgttcgggcggctgctgtccttgcgcggcgaaaacagccgcctgcgtgcggaagtgaagaaaagtgcgcgcttgagcggacagaaattgactgcaccgccgatacaaaatgctgccgaatctgccaaacagccttaa

SEQ ID NO: 1750 - protein, 160 aa, Neisseria gonorrhoeae
MERSGVFGKIVGNRILRMPSEHAAAFYPKPCKSFKLTQSWFRVRSCPCGVFIYGANMKLIYTVIKIIILLLFLLLAVINMDAVTFSYLPGQSVNLPLIVVLFGAFVVGIVFGMFALFGRLLSLRGENSRLRAEVKKSARLSGQKLTAPPIQNAAESAKQP

SEQ ID NO: 1751 - DNA, 483 bp, Neisseria meningitidis
atggaaaggaacggtgtatttggtaaaattgtcggcaatcgcatactccgtatgtcgtccgaacacgctgccgcatcctatccgaaaccgtgcaaatcgtttaaactagcgcaatcttggttcagagtgcgaagctgtctgggcggcgtttttatttacggagcaaacatgaaacttatctataccgtcatcaaaatcattatcctgctgctcttcctgctgcttgccgtcattaatacggatgccgttaccttttcctacctgccggggcaaaaattcgatttgccgctgattgtcgtattgttcggcgcatttgtagtcggtattatttttggaatgtttgccttgttcggacggttgttgtcgttacgtggcgagaacggcaggttgcgtgccgaagtaaagaaaaatgcgcgtttgacggggaaggagctgaccgcaccaccggcgcaaaatgcgcccgaatctaccaaacagccttaa

SEQ ID NO: 1752 - protein, 160 aa, Neisseria meningitidis
MERNGVFGKIVGNRILRMSSEHAAASYPKPCKSFKLAQSWFRVRSCLGGVFIYGANMKLIYTVIKIIILLLFLLLAVINTDAVTFSYLPGQKFDLPLIVVLFGAFVVGIIFGMFALFGRLLSLRGENGRLRAEVKKNARLTGKELTAPPAQNAPESTKQP

SEQ ID NO: 1753 - DNA, 483 bp, Neisseria meningitidis
atggaaaggaacggtgtatttggtaaaattgtcggcaatcgcatactccgtatgtcgtccgaacacgctgccgcatcctatccgaaaccgtgcaaatcgtttaaactagcgcaatcttggttcagagtgcgaagctgtccgggcggcgtttttatttacggagcaaacatgaaacttatctataccgtcatcaaaatcattatcctgctgctcttcctgctgcttgctgtcattaatacggatgccgttaccttttcctacctgccggggcaaaaattcgatttgccgctgattgtcgtattgttcggcgcgtttgtcgtcggcatcgtgttcggaatgtttgccttgttcggacggttgttgtcgttacgtggcgagaacggcaggttgcgtgccgaagtaaagaaaaatgcgcgtttgacggggaaggagctgaccgcaccaccggcgcaaaatgcgcccgaatctgccaaacagccttga

SEQ ID NO: 1754 - protein, 160 aa, Neisseria meningitidis
MERNGVFGKIVGNRILRMSSEHAAASYPKPCKSFKLAQSWFRVRSCPGGVFIYGANMKLIYTVIKIIILLLFLLLAVINTDAVTFSYLPGQKFDLPLIVVLFGAFVVGIVFGMFALFGRLLSLRGENGRLRAEVKKNARLTGKELTAPPAQNAPESAKQP

SEQ ID NO: 1755 - DNA, 321 bp, Neisseria gonorrhoeae
atgggaaagctcgacatcgggatattgtttgccgatttcttcaaagatttcgcgccacagttcggtggtttccaaaacgttggctttgcctacggagcagacttttttgctgcgtttttgggcggattggaaggccacgtgggcgatgcggcggatttcgctttcgctgtatttcatggtgttgtagccttcgtgttcgccgttttccaaaacacggatgccgcgcggttcgccgaaataaatatcgccggtaagttcgcgcacaatcaaaatatccaaaccggcaacgatttcaggcttgagcgtggaggcgttggctaa

SEQ ID NO: 1756 - protein, 106 aa, Neisseria gonorrhoeae
MGKLDIGILFADFFKDFAPQFGGFQNVGFAYGADFFAAFLGGLEGHVGDAADFAFAVFHGVVAFVFAVFQNTDAARFAEINIAGKFAHNQNIQTGNDFRLERGGVG

SEQ ID NO: 1757 - DNA, 300 bp, Neisseria meningitidis
atgggaaagctcgacatcagggtactctttgccgatttcttcaaagatttcgcgccacaattcggtggtttccaaaacgttggctttgcctacggaacagacttttttgctgcgtttttgggcggattggaaggcaacatgggcaatacggcggatttcgctttcgctgtatttcatggtgttgtagccttcgcgttcgccgttttccagaacgcggatgccgcgcggttcgccgaaatagatgtcgccggtgagttcgcgcacaatcaaaatatccaaaccggcaacgatttcaggctt

SEQ ID NO: 1758 - protein, 106 aa, Neisseria meningitidis
MGKLDIRVLFADFFKDFAPQFGGFQNVGFAYGTDFFAAFLGGLEGNMGNTADFAFAVFHGVVAFAFAVFQNADAARFAEIDVAGEFAHNQNIQTGNDFRLQRGGVG

SEQ ID NO: 1759 - DNA, 321 bp, Neisseria meningitidis
atgggaaagctcgacatcagggtattctttgccgatttcttcaaagatttcgcgccacaattcggtggtttccaaaacgttggctttgcctacggagcagacttttttgctgcgtttttgggcggattggaaggcgacgtgggcaatacggcggatttcgctttcgctgtatttcatggtgttgtagccttcgcgttcgccgttttccagaacacggatgccgcgcggttcgccgaaataaatatcgccggtgagttcgcgcacaatcaaaatatccaaacccgcaacgatttcagacttgagcgtggaggcgttggctag

SEQ ID NO: 1760 - protein, 106 aa, Neisseria meningitidis
MGKLDIRVFFADFFKDFAPQFGGFQNVGFAYGADFFAAFLGGLEGDVGNTADFAFAVFHGVVAFAFAVFQNTDAARFAEINIAGEFAHNQNIQTRNDFRLERGGVG

SEQ ID NO: 1761 - DNA, 696 bp, Neisseria gonorrhoeae
atgagggcggcgatgacgcgcgcgcaggtcgatgccacgctgattagttttttgtgtaatgttgccaatatcggcttattgattttggtgattattgccgcattgggacggttgggcgtttccacaacatccgtaaccgccttaatcggcggcgcgggtttggcggtggcgttgtccttaaaagaccagctgtccaattttgccgccggcgcgctgattatcctgttccgcccgttcaaagtcggcgactttatccgtgtcggcggttttgaaggatatgtccgggaaatcaaaatggtgcagacttctttgcggacgaccgacaacgaagaagtcgtgctgcccaacagcgtggtgatgggcaacagcatcgtcaaccgttccagcctgccgctttgccgcgcccaagtgatagtcggcgtcgattacaactgcgatttgaaagtggcgaaagaggcggtgttgaaagccgccgccgaacaccccttgagcgttcaaaacgaagagcggcagcccgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaa

SEQ ID NO: 1762 - protein, 231 aa, Neisseria gonorrhoeae
MRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSSLPLCRAQVIVGVDYNCDLKVAKEAVLKAAAEHPLSVQNEERQPAAYITALGDNAIEITLWAWANEADRWTLQCDLNEQVVENLRKVNINIPFPQRDIHIINS

SEQ ID NO: 1763 - DNA, 696 bp, Neisseria meningitidis
atgagggcggcgatgacgcgcgcgcaggtcgatgccacgctgattagttttttgtgtaatgttgccaatatcggcttattgattttggtgattattgccgcattgggcagattgggcgtttccacaacatccgtaaccgccttaatcggcggcgcgggtttggcggtggcgttgtccctgaaagaccagctgtccaattttgccgccggcgcactgattatcctgttccgcccgttcaaagtcggcgattttatccgcgtcggcggttttgaaggatatgtccgagagattaaaatggtgcagacttctttgcggacgaccgacaacgaagaagtcgtgctgcccaacagcgtggtgatgggcaacagcatcgtcaaccgttccacactgccgctgtgccgcgcccaagtgatagtcggcgtcgattacaactgcgatttgaaagtggcgaaagaggcggtgttgaaagccgccgtcgaacaccccttgagcgttcaaaacgaagagcggcaggctgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaa

SEQ ID NO: 1764 - protein, 231 aa, Neisseria meningitidis
MRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSTLPLCRAQVIVGVDYNCDLKVAKEAVLKAAVEHPLSVQNEERQAAAYITALGDNAIEITLWAWANEADRWTLQCDLNEQVVENLRKVNINIPFPQRDIHIINS

SEQ ID NO: 1765 - DNA, 696 bp, Neisseria meningitidis
atgagggcggcgatgacgcgcgcgcaggtcgatgccacgctgattagttttttgtgtaatgttgccaatatcggcttattgattttggtgattattgccgcattgggcagattgggcgtttccacaacatccgtaaccgccttaatcggcggcgcgggtttggcggtggcgttgtccttgaaagaccagctgtccaattttgccgccggcgcgctgattatcctgttccgcccgttcaaagtcggcgattttatccgcgtcggcggttttgaaggatatgtccgagagattaaaatggtgcagacttctttgcggacgaccgacaacgaagaagtcgtgctgcccaacagcgtggtgatgggcaacagcatcgtcaaccgttccacactgccgctgtgccgcgcccaagtgatagtcggcgtcgattacaactgcgatttgaaagtggcgaaagaggcggtgttgaaagccgccgtcgaacaccccttgagcgttcaaaacgaagagcggcaggccgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaa

SEQ ID NO: 1766 - protein, 231 aa, Neisseria meningitidis; identical to SEQ ID NO: 1764

SEQ ID NO: 1767 - DNA, 849 bp, Neisseria gonorrhoeae
atggacttcaaacaatttgattttttacacctgatcagtgtttccggttgggggcatctggctgaaaaggcgtgggcgttcgggctgaaccttgccgccgcgctgcttattttcttggtcgggaaatgggcggcgaaacgcattgtcgccgtaatgagggcggcgatgacgcgcgcgcaggtcgatgccacgctgattagttttttgtgtaatgttgccaatatcggcttattgattttggtgattattgccgcattgggacggttgggcgtttccacaacatccgtaaccgccttaatcggcggcgcgggtttggcggtggcgttgtccttaaaagaccagctgtccaattttgccgccggcgcgctgattatcctgttccgcccgttcaaagtcggcgactttatccgtgtcggcggttttgaaggatatgtccgggaaatcaaaatggtgcagacttctttgcggacgaccgacaacgaagaagtcgtgctgcccaacagcgtggtgatgggcaacagcatcgtcaaccgttccagcctgccgctttgccgcgcccaagtgatagtcggcgtcgattacaactgcgatttgaaagtggcgaaagaggcggtgttgaaagccgccgccgaacaccccttgagcgttcaaaacgaagagcggcagcccgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaa

SEQ ID NO: 1768 - protein, 282 aa, Neisseria gonorrhoeae
MDFKQFDFLHLISVSGWGHLAEKAWAFGLNLAAALLIFLVGKWAAKRIVAVMRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSSLPLCRAQVIVGVDYNCDLKVAKEAVLKAAAEHPLSVQNEERQPAAYITALGDNAIEITLWAWANEADRWTLQCDLNEQVVENLRKVNINIPFPQRDIHIINS

SEQ ID NO: 1769 - DNA, 849 bp, Neisseria meningitidis
atggacttcaaacaatttgattttttacacctgatcagtgtttccggttgggagcatctggctgaaaaggcgtgggcgttcgggctgaaccttgccgccgcgctgcttatttttttggtcggaaaatgggcggcgaaacgcattgtcgctgtgatgagggcggcgatgacgcgcgcgcaggtcgatgccacgctgattagttttttgtgtaatgttgccaatatcggcttattgattttggtgattattgccgcattgggcagattgggcgtttccacaacatccgtaaccgccttaatcggcggcgcgggtttggcggtggcgttgtccctgaaagaccagctgtccaattttgccgccggcgcactgattatcctgttccgcccgttcaaagtcggcgattttatccgcgtcggcggttttgaaggatatgtccgagagattaaaatggtgcagacttctttgcggacgaccgacaacgaagaagtcgtgctgcccaacagcgtggtgatgggcaacagcatcgtcaaccgttccacactgccgctgtgccgcgcccaagtgatagtcggcgtcgattacaactgcgatttgaaagtggcgaaagaggcggtgttgaaagccgccgtcgaacaccccttgagcgttcaaaacgaagagcggcaggctgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaa

SEQ ID NO: 1770 - protein, 282 aa, Neisseria meningitidis
MDFKQFDFLHLISVSGWEHLAEKAWAFGLNLAAALLIFLVGKWAAKRIVAVMRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSTLPLCRAQVIVGVDYNCDLKVAKEAVLKAAVEHPLSVQNEERQAAAYITALGDNAIEITLWAWANEADRWTLQCDLNEQVVENLRKVNINIPFPQRDIHIINS

SEQ ID NO: 1771 - DNA, 849 bp, Neisseria meningitidis
atggacttcaaacaatttgattttttacacctgataagtgcttccggctgggagcatctggctgaaaaggcgtgggcgttcgggctgaaccttgccgccgcgctgcttatttttttggtcggaaaatgggcggcgaaacgcattgtcgccgtgatgagggcggcgatgacgcgcgcgcaggtcgatgccacgctgattagttttttgtgtaatgttgccaatatcggcttattgattttggtgattattgccgcattgggcagattgggcgtttccacaacatccgtaaccgccttaatcggcggcgcgggtttggcggtggcgttgtccttgaaagaccagctgtccaattttgccgccggcgcgctgattatcctgttccgcccgttcaaagtcggcgattttatccgcgtcggcggttttgaaggatatgtccgagagattaaaatggtgcagacttctttgcggacgaccgacaacgaagaagtcgtgctgcccaacagcgtggtgatgggcaacagcatcgtcaaccgttccacactgccgctgtgccgcgcccaagtgatagtcggcgtcgattacaactgcgatttgaaagtggcgaaagaggcggtgttgaaagccgccgtcgaacaccccttgagcgttcaaaacgaagagcggcaggccgccgcctacatcaccgccttgggcgacaatgccatcgaaatcacattatgggcttgggcaaacgaagcagaccgctggacgctgcaatgcgacttgaacgaacaagtggtcgaaaacctccgcaaagtcaatatcaacatcccgttcccgcaacgcgacatacacatcatcaattcttaa

SEQ ID NO: 1772 - protein, 282 aa, Neisseria meningitidis
MDFKQFDFLHLISASGWEHLAEKAWAFGLNLAAALLIFLVGKWAAKRIVAVMRAAMTRAQVDATLISFLCNVANIGLLILVIIAALGRLGVSTTSVTALIGGAGLAVALSLKDQLSNFAAGALIILFRPFKVGDFIRVGGFEGYVREIKMVQTSLRTTDNEEVVLPNSVVMGNSIVNRSTLPLCRAQVIVGVDYNCDLKVAKEAVLKAAVEHPLSVQNEERQAAAYITALGDNAIEITLWAWANEADRWTLQCDLNEQVVENLRKVNINIPFPQRDIHIINS

SEQ ID NO: 1773 - DNA, 303 bp, Neisseria gonorrhoeae
atggattcgcccaaggtcgggtgcgggtggatggttttgccgatgtctgccgcgtcgcagcccatttcgatggcaaggcagacttcgccgatcatgtcgccaccgttcggaccgacaatgccgccgccgatgatgcggccggtttcggcatcgaaaatcagcttggtaaagccgttgtcgcaaccgttggcaatcgcacgaccggaagccgcccatgggaagttggctttggtaattttgcggcctgatgctttggcagacaattcggtttcaccgacccatgccacttcgggggaagtgtag

SEQ ID NO: 1774 - protein, 100 aa, Neisseria gonorrhoeae
MDSPKVGCGWMVLPMSAASQPISMARQTSPIMSPPFGPTMPPPMMRPVSASKISLVKPLSQPLAIARPEAAHGKLALVILRPDALADNSVSPTHATSGEV

SEQ ID NO: 1775 - DNA, 303 bp, Neisseria meningitidis
atggattcgcccaaggtcgggtgcgggtggatggttttgccgatgtctgccgcgtcgcagcccatttcgatggcaaggcagacttcgccgatcatatcgccaccgttcggaccgacaatgccgccgccgatgatgcggccggtttcggcatcaaaaatcagcttggtaaagccgttgtcgcaaccgttggcaatcgcacggccggaagccgcccacgggaagttggctttggtgattttgcggccggaggctttggcggacagttcggtttcgcccacccacgccacttcgggggaagtgtag

SEQ ID NO: 1776 - protein, 100 aa, Neisseria meningitidis
MDSPKVGCGWMVLPMSAASQPISMARQTSPIISPPFGPTMPPPMMRPVSASKISLVKPLSQPLAIARPEAAHGKLALVILRPEALADSSVSPTHATSGEV

SEQ ID NO: 1777 - DNA, 303 bp, Neisseria meningitidis
atggattcgcccaaggtcgggtgcgggtggatggttttgccgatgtctgccgcgtcgcagcccatttcgatggcaaggcagacttcgccgatcatgtcgccaccgttcggaccgacaatgccgccgccgatgatgcggccggtttcagcatcaaaaatcagcttggtgaaaccattgtcgcaaccgttggcaatcgcacggccggaagcagcccatgggaagttggctttggtgattttgcggccggaggctttggcagacaattcggtttcgcccacccatgccacttcaggagaagtgtaa

SEQ ID NO: 1778 - protein, 100 aa, Neisseria meningitidis
MDSPKVGCGWMVLPMSAASQPISMARQTSPIMSPPFGPTMPPPMMRPVSASKISLVKPLSQPLAIARPEAAHGKLALVILRPEALADNSVSPTHATSGEV

SEQ ID NO: 1779 - DNA, 342 bp, Neisseria gonorrhoeae
atgcacttcgcccagcttgtgggtcaaaccggtatagaacaaaatacgttctgtcgtcgtggttttacccgcatcgatatgggcggaaataccgatgttgcggtacaggctgatcggggtcttacgagccattttattagcctttcaaaattagaaacggaagtgagagaatgctttgttggcttcagccatacggtgtacttcttcacgttttttcaacgcaccgccacggccttcggacgcatcaatcaactcgcctgccaaacgcagatccatggatttctcaccacgtttgcgggccgcgtcgcgaacccaacgcattgccaaagccagacggcgtga

SEQ ID NO: 1780 - protein, 113 aa, Neisseria gonorrhoeae
MHFAQLVGQTGIEQNTFCRRGFTRIDMGGNTDVAVQADRGLTSHFISLSKLETEVRECFVGFSHTVYFFTFFQRTATAFGRINQLACQTQIHGFLTTFAGRVANPTHCQSQTA

SEQ ID NO: 1781 - DNA, 342 bp, Neisseria meningitidis
atgcacttcgcccagcttgtgggtcaaaccggtatagaacaaaatacgttctgtcgtcgtggttttacccgcgtcaatatgggcggaaataccgatgttacggtacaggctgatcggggtcttacgagccattttattagcctttcaaaattagaaacggaagtgagagaatgctttgttggcttcagccatacggtgtacttcttcacgttttttcaacgcaccgccacggccttcggacgcatcaatcaattcgcctgccaaacgcaggtccatggatttctcaccacgtttgcgggccgcatcgcgaacccagcgcattgccaaagccaaacggcgtga

SEQ ID NO: 1782 - protein, 113 aa, Neisseria meningitidis
MHFAQLVGQTGIEQNTFCRRGFTRVNMGGNTDVTVQADRGLTSHFISLSKLETEVRECFVGFSHTVYFFTFFQRTATAFGRINQFACQTQVHGFLTTFAGRIANPAHCQSQTA

SEQ ID NO: 1783 - DNA, 342 bp, Neisseria meningitidis
atgcacttcgcccagcttgtgggtcaaaccggtatagaacaaaatacgttctgtcgtcgtggttttacccgcatcgatatgggcggaaataccgatgttacggtacaggctgatcggggtcttacgagccattttattagcctttcaaaattagaaacggaagtgagagaatgctttgttggcttcagccatacggtgtacttcttcacgttttttcaacgcaccgccacggccttcggacgcatcaatcaattcgcctgccaaacgcaggtccatggatttctcaccacgtttgcgggccgcatcgcgaacccagcgcattgccaaagccaaacggcgtga

SEQ ID NO: 1784 - protein, 112 aa, Neisseria meningitidis
MHFAQLVGQTGIEQNTFCRRGFTRIDMGGNTDVTVQADRGLTSHFISLSKLETEVRECFVGFSHTVYFFTFFQRTATAFGRINQFACQTQVHGFLTTFAGRINPAHCQSQTA

SEQ ID NO: 1785 - DNA, 1113 bp, Neisseria gonorrhoeae
atgcgctatattcttttgacaggactgttgccgacggcatccgcttttggagagaccgcgctgcaatgcgccgctttgacggacaatgttacgcgtttggcgtgttacgacaggatttttgcggcacagcttccgtcttcggcagggcaggaagggcaggagtcgaaagccgtactcaatctgacggaaaccgtccgcagcagcttggataagggcgaggcggtcattgttgttgaaaaaggcggggatgcgcttcctgccgacagtgcgggcgaaaccgccgatatctatacgcctttgagcctgatgtacgacttggacaaaaacgatttgcgcgggctgttgggcgtacgcgaacacaatccgatgtaccttatgccgttttggtataacaattcgcccaactatgccccgagttcgccgacgcgcggtacgactgtacaggaaaaattcggacagcagaaacgtgcggaaaccaaattgcaggtttcgttcaaaagcaaaattgccgaaaatttgtttaaaacccgcgcggatctgtggttcggctacacccaaagatccgattggcagatttacaaccaaggcaggaaatccgcgccgttccgcaatacggattacaaacctgaaattttcctgacccagcctgtgaaggcggatttgccgttcggcggcaggctgcgtatgctcggtgcgggttttgtccaccagtccaacggacagagccgtcccgaatcgcgttcgtggaacaggatttatgccatggcaggcatggaatggggcaaattgacggtgattccgcgcgtgtgggtgcgtgcgttcgatcagagcggcgataaaaacgacaatcccgatattgccgactatatggggtatggcgacgtgaagctgcagtaccgcctgaacgacaggcagaatgtgtattccgtattgcgctacaaccccaaaacgggctacggcgcgattgaagccgcctacacgtttccgattaagggcaaactcaaaggcgtggtacgcggattccacggttacggcgagagcctgatcgactacaaccacaagcagaacggtatcggtatcgggttgatgttcaacgactgggacggcatctga

SEQ ID NO: 1786 - protein, 370 aa, Neisseria gonorrhoeae
MRYILLTGLLPTASAFGETALQCAALTDNVTRLACYDRIFAAQLPSSAGQEGQESKAVLNLTETVRSSLDKGEAVIVVEKGGDALPADSAGETADIYTPLSLMYDLDKNDLRGLLGVREHNPMYLMPFWYNNSPNYAPSSPTRGTTVQEKFGQQKRAETKLQVSFKSKIAENLFKTRADLWFGYTQRSDWQIYNQGRKSAPFRNTDYKPEIFLTQPVKADLPFGGRLRMLGAGFVHQSNGQSRPESRSWNRIYAMAGMEWGKLTVIPRVWVRAFDQSGDKNDNPDIADYMGYGDVKLQYRLNDRQNVYSVLRYNPKTGYGAIEAAYTFPIKGKLKGVVRGFHGYGESLIDYNHKQNGIGIGLMFNDWDGI

SEQ ID NO: 1787 - DNA, 1113 bp, Neisseria meningitidis
atgcgctatattcttttgacaggactgttgccgatggcatccgcttttggagagaccgcgctgcaatgcgccgctttgacggacaatgttacgcgtttggcgtgttacgacaggatttttgcggcacagcttccgtcttcggcagggcaggaagggcaggagtcgaaagccgtactcaatctgacggaaaccgtccgcagcagcctggataagggcgaggcggtcattgttgttgaaaaaggcggggatgcgcttcctgccgacagtgcgggcgaaaccgccgacatctatacgcctttgagcctgatgtacgacttggacaaaaacgatttgcgcgggctgttgggcgtacgcgaacacaatccgatgtaccttatgccgctctggtacaacaattcgcccaactatgccccgggttcgccgacgcgcggtacgactgtacaggaaaaattcggacagcagaaacgtgcggaaaccaaattgcaggtttcgttcaaaagcaaaattgccgaagatttgtttaaaacccgcgcggatctgtggttcggctacacccaaagatccgattggcagatttacaaccaaggcaggaaatccgcgccgttccgcaatacggattacaaacctgaaattttcctgacccagcctgtgaaggcggatttgccgttcggcggcaggctgcgtatgctcggtgcgggttttgtccaccagtccaacggacagagccgtcccgaatcgcgttcgtggaacaggatttacgccatggcaggcatggaatggggcaaattgacggtgattccgcgcgtgtgggtgcgtgcgttcgatcagagcggcgataaaaacgacaatcccgatattgccgactatatggggtatggcgacgtgaagctgcagtaccgcctgaacgacaggcagaatgtgtattccgtattgcgctacaaccccaaaacgggctacggcgcgattgaagccgcctacacgtttccgattaagggcaaactcaaaggcgtggtacgcggattccacggttacggcgagagcctgatcgactacaaccacaagcagaacggtatcggtatcgggttgatgttcaacgacttggacggcatctga

SEQ ID NO: 1788 - protein, 370 aa, Neisseria meningitidis
MRYILLTGLLPMASAFGETALQCAALTDNVTRLACYDRIFAAQLPSSAGQEGQESKAVLNLTETVRSSLDKGEAVIVVEKGGDALPADSAGETADIYTPLSLMYDLDKNDLRGLLGVREHNPMYLMPLWYNNSPNYAPGSPTRGTTVQEKFGQQKRAETKLQVSFKSKIAEDLFKTRADLWFGYTQRSDWQIYNQGRKSAPFRNTDYKPEIFLTQPVKADLPFGGRLRMLGAGFVHQSNGQSRPESRSWNRIYAMAGMEWGKLTVIPRVWVRAFDQSGDKNDNPDIADYMGYGDVKLQYRLNDRQNVYSVLRYNPKTGYGAIEAAYTFPIKGKLKGVVRGFHGYGESLIDYNHKQNGIGIGLMFNDLDGI

SEQ ID NO: 1789 - DNA, 1113 bp, Neisseria meningitidis
atgcgctatattcttttgacaggactgttgccgatggcatccgcttttggagagaccgcgctgcaatgcgccgctttgacggacaatgttacgcgtttggcgtgttacgacaggatttttgcggcacagcttccgtcttcggcagggcaggaagggcaggagtcgaaagccgtactcaatctgacggaaaccgtccgcagcagcctggataagggcgaggcggtcattgttgttgaaaaaggcggggatgcgcttcctgccgacagtgcgggcgaaaccgccgacatctatacgcctttgagcctgatgtacgacttggacaaaaacgatttgcgcgggctgttgggcgtacgcgaacacaatccgatgtaccttatgccgctctggtacaacaattcgcccaactatgccccgggttcgccgacgcgcggtacgactgtacaggaaaaattcggacagcagaaacgtgcggaaaccaaattgcaggtttcgttcaaaagcaaaattgccgaagatttgtttaaaacccgcgcggatctgtggttcggctacacccaaagatccgattggcagatttacaaccaaggcaggaaatccgcgccgttccgcaatacggattacaaacctgaaattttcctgacccagcctgtgaaggcggatttgccgttcggcggcaggctgcgtatgctcggtgcgggttttgtccaccagtccaacggacagagccgtcccgaatcgcgttcgtggaacaggatttacgccatggcaggcatggaatggggcaaattgacggtgattccgcgcgtgtgggtgcgtgcgttcgatcagagcggcgataaaaacgacaatcccgatattgccgactatatggggtatggcgacgtgaagctgcagtaccgcctgaacgacaggcagaatgtgtattccgtattgcgctacaatcccaaaacgggctacggcgcgattgaagccgcctacacgtttccgattaagggcaaactcaaaggcgtggtacgcggattccacggttacggcgagagcctgatcgactacaaccacaagcagaacggtatcggtatcgggttgatgttcaacgacttggacggcatctga

SEQ ID NO: 1790 - protein, 370 aa, Neisseria meningitidis; identical to SEQ ID NO: 1788

SEQ ID NO: 1791 - DNA, 609 bp, Neisseria gonorrhoeae
atgataattgaccaaagccaaatatttacccatcttgccttctgtgccttttgcgggattggagccgtaactgccggcaatcgactgcataatcggatgtataatgccgccgccgcgcgcggtattggaaggggtaacgggagccagcagcagttcggaaagagcgagactgtaaccgatgcccagcgtttttcttccaaaaacggcgataaacaaatatccgatacgcatccccagccctgttttgagcaaaccgcgcgaaatcataactgcgatggcaatcagccaaatcaacggattggcgaacgcactcaacgcatcgctcatcgccgcgcccggtttgtcggcggttacgccggttactgcgaccaacccgacggcaataatcgacagcgcgcccaacggcataaccttgccgataatggcggcaatcacaccgacaaacatagccagcagcgtccaagcctgaggcttgaccccgtcgggtacgggcagtgccaaaaccagggcgcacaatactgcggcaatggcgaggggtatcggtttgaaacccaatttcatcatattgacctccgtaaaaaagaccgtcccgaaaaatcggaaaaataa

SEQ ID NO: 1792 - protein, 202 aa, Neisseria gonorrhoeae
MIIDQSQIFTHLAFCAFCGIGAVTAGNRLHNRMYNAAAARGIGRGNGSQQQFGKSETVTDAQRFSSKNGDKQISDTHPQPCFEQTARNHNCDGNQPNQRIGERTQRIAHRRARFVGGYAGYCDQPDGNNRQRAQRHNLADNGGNHTDKHSQQRPSLRLDPVGYGQCQNQGAQYCGNGEGYRFETQFHHIDLRKKDRPEKSEK

SEQ ID NO: 1793 - DNA, 609 bp, Neisseria meningitidis
atgatagttgaccaaagccaaatatttacccatcttgccttctgtgccttttgcgggattggagccgtaactgccggcaatcgactgcataatcggatgtataatgccgccgccgcgcgcggtattggaaggggtaacgggagccagcagcagttcggaaagagcgagactgtaaccgatgcccagcgtttttcttccaaaaacggcgataaacaaatatccgatacgcatccccagccctgttttgagcaaaccgcgcgaaatcataactgcgatggcaatcagccaaatcaacggattggcgaacgcactcaacgcatcgctcatcgccgcgcccggtttgtcggcggttacgccggttactgcgaccaacccgacggcaataatcgacagcgcgcccaacggcatggccttgccgataatggcggcaatcacaccgacaaacatggccagcagcgtccaagcctgaggcttgaccccgtcgggtacgggcagtgccaaaaccagggcgcacaatactgcggcaatggcgaggggtatcggtttgaaacccaatttcatcatattgacctccgtaaaaaagaccgtcccgaaaaatcggaaaaataa

SEQ ID NO: 1794 - protein, 202 aa, Neisseria meningitidis
MIVDQSQIFTHLAFCAFCGIGAVTAGNRLHNRMYNAAAARGIGRGNGSQQQFGKSETVTDAQRFSSKNGDKQISDTHPQPCFEQTARNHNCDGNQPNQRIGERTQRIAHRRARFVGGYAGYCDQPDGNNRQRAQRHGLADNGGNHTDKHGQQRPSLRLDPVGYGQCQNQGAQYCGNGEGYRFETQFHHIDLRKKDRPEKSEK

SEQ ID NO: 1795 - DNA, 609 bp, Neisseria meningitidis
atgatagttgaccaaagccaaatatttacccatcttgccttctgtgccttttgcgggattggagccgtaactgccggcaatcgactgcataatcggatgtataatgccgccgccgcgcgcggtattggaaggggtaacgggagccagcagcagttcggaaagagcgagactgtaaccgatgcccagcgtttttcttccaaaaacggcgataaacaaatatccgatacgcatccccagccctgttttgagcaaaccgcgcgaaatcataactgcgatggcaatcagccaaatcaacggattggcgaacgcactcaacgcatcgctcatcgccgcacccggtttgtcggcggttacgccggttactgcgaccaacccgacggcaataatcgacagcgcacccaacggcatggccttgccgataatggcggcaatcacaccgataaacatggccagcagcgtccaagcctgaggcttgaccccgtcgggtacgggcagtgccaaaaccaaggcgcacaatactgcggcaatggcgaggggtatcggtttgaaacccaatttcatcatattgacctccgtaaaaaagaccgtcccgaaaaatcggaaaaataa

SEQ ID NO: 1796 - protein, 202 aa, Neisseria meningitidis
MIVDQSQIFTHLAFCAFCGIGAVTAGNRLHNRMYNAAAARGIGRGNGSQQQFGKSETVTDAQRFSSKNGDKQISDTHPQPCFEQTARNHNCDGNQPNQRIGERTQRIAHRRTRFVGGYAGYCDQPDGNNRQRTQRHGLADNGGNHTDKHGQQRPSLRLDPVGYGQCQNQGAQYCGNGEGYRFETQFHHIDLRKKDRPEKSEK

SEQ ID NO: 1797 - DNA, 705 bp, Neisseria gonorrhoeae
atgctgcgttctattttggcggcttccctgctggcggtatcttttccggcggcggctgaggcattgaattacaatattgtcgaattttccgaatcggcgggtatcgaggtggctcaggatacaatgtccgcgcgtttccaggtggcggcggaaggacgggacaaaaatgccgtcaatgccgagtttgttaaaaaattcaacaatttcaccagaaaatcgaaaaatggtagctttaaaaccgaattggtatcgcgcagtgcgatgccgcgctatcaatataccaacggcagacgcattcaaacaggctgggaggagcgtgcggaatttaaggcggagggcagggattttgatgctttaaaccgttttattgctgatgttcagacggatgcttcgcttgaagataccgatttcagcgtgtcgcgcgaacgccgaaacgaggtcatcgatcaggtcagcaaggatgccgttttgcgtttcaaggcgcgtgccgaaaaactggcgggcgttctgggtgcgtccggttataaaatcgtcaaattgaattttgggcaaatcggcagccatattgcgggcgatggggctgttcgggcaaaaatgctgcgcgcgatgccgatggcggcaagcgtcaatatgaagggtacggattcagccgcaccgggtgtggaggaaatcagcatcagcatcaatgggacggttcagttctaa

SEQ ID NO: 1798 - protein, 234 aa, Neisseria gonorrhoeae
MLRSILAASLLAVSFPAAAEALNYNIVEFSESAGIEVAQDTMSARFQVAAEGRDKNAVNAEFVKKFNNFTRKSKNGSFKTELVSRSAMPRYQYTNGRRIQTGWEERAEFKAEGRDFDALNRFIADVQTDASLEDTDFSVSRERRNEVIDQVSKDAVLRFKARAEKLAGVLGASGYKIVKLNFGQIGSHIAGDGAVRAKMLRAMPMAASVNMKGTDSAAPGVEEISISINGTVQF

SEQ ID NO: 1799 - DNA, 705 bp, Neisseria meningitidis
atgttgcgtcttgttttggcggcttcgctgtcggcggtatcttttccggcagcggctgaagcattgaattacaatattgtcgaattttccgaatcggcgggtgtcgaggtggctcaggatacaatgtccgcacgtttccaagtgacggcggaaggacgggacaaaaatgccgtcaatgctgagtttgttaaaaaattcaacaagttcatcagaaaatcgaaaaatggtagctttaaaaccgaattggtatcgcgcagtgcgatgccgcgctatcaatataccaacggcagacgcattcaaacaggctgggaggagcgtgcggaatttaaggtcgaaggtagagattttgatgagttaaaccgttttattgccgatattcaagcagatgccgcgttggmatatacggatttccatgtgtcgcgcgaacgccgcaacgaggtcatckatcaggtcagcaaggatgccgttttgcgtttcaaggcgcgtgccgaaaagttggcgggcgttttgggtgcgtccggttataaaatcgtcaaattgaatttgggacacatcggcagccatatcgcgggagggggagctgctcaggcaaaaatgcttcgtgccatgccgatggcggcaagcgtcaatatggagggtgcggattccgccgcgcctggtgtggaggaaatcagcatcagcgtcaatgggacggttcagttctga

SEQ ID NO: 1800 - protein, 234 aa, Neisseria meningitidis
  misc_feature (133)..(133): Xaa can be any naturally occurring amino acid
  misc_feature (149)..(149): Xaa can be any naturally occurring amino acid
MLRLVLAASLSAVSFPAAAEALNYNIVEFSESAGVEVAQDTMSARFQVTAEGRDKNAVNAEFVKKFNKFIRKSKNGSFKTELVSRSAMPRYQYTNGRRIQTGWEERAEFKVEGRDFDELNRFIADIQADAALXYTDFHVSRERRNEVIXQVSKDAVLRFKARAEKLAGVLGASGYKIVKLNLGHIGSHIAGGGAAQAKMLRAMPMAASVNMEGADSAAPGVEEISISVNGTVQF

SEQ ID NO: 1801 - DNA, 663 bp, Neisseria meningitidis
atgttgcgttctattttggcggcttccctgctgattgtcgaattttctgaatcggcgggtgtcgaggcggttcaggatacaatgtccgcacgtttccaagtgacggcggaaggacgggacaaaaatgccgtcaatgccgagtttgttaaaaaattcaacaatttcaccagaaaatcaaaaaatggtagctttaaaaccgaattggtatcgcgcagtgcgatgccgcgctatcaatataccaacggcagacgcattcaaacaggttgggaggagcgtgcggaatttaaggtcgagggtaggaattttgatgcgttgaaccgttttattgccgatgttcaggcagatgccgcgttggaatatacggatttccatgtgtcgcgcgaacgccgcaacgaggtcatcgatcaggtcagcaaggatgccgttttgcgtttcaaggcgcgtgccgaaaagttggcgggcgttttgggtgcgtccggttataaaatcgtcaaattgaatttgggacacatcggcagccatatcgcgggagggggagctgctcaggcaaaaatgcttcgtgccatgccgatggcggcaagcgtcaatatggagggtgcggattccgccgcgcctggtgtggaggaaatcagcatcagcgtcaatgggacggttcagttctga

SEQ ID NO: 1802 - protein, 220 aa, Neisseria meningitidis
MLRSILAASLLIVEFSESAGVEAVQDTMSARFQVTAEGRDKNAVNAEFVKKFNNFTRKSKNGSFKTELVSRSAMPRYQYTNGRRIQTGWEERAEFKVEGRNFDALNRFIADVQADAALEYTDFHVSRERRNEVIDQVSKDAVLRFKARAEKLAGVLGASGYKIVKLNLGHIGSHIAGGGAAQAKMLRAMPMAASVNMEGADSAAPGVEEISISVNGTVQF

SEQ ID NO: 1803 - DNA, 696 bp, Neisseria gonorrhoeae
atgaaactgttccaacgcattttcgccacattttgcgcggttatcgtctgcgcaatctttgtggcgagtttttctttttggctggtgcagaacacccttgccgaaaaccaattcaaccaacgccgcaccatcgaaaccacattgatgggcagcattatttccgcattcaagacacggggcgacaacggcgcgcgcgaaatcctgaccgaatggaaaaacagccccgtctcatccgccgtttacgtcatacagggcgacgagaaaaaagacatcttaaaccgctatatcgacaattacaccatagaacgcgcccggctgtttgccgccaacaacccccattccaaccttgtccgcatcgaatacgaccgtttcggcgaagaatacctgttcttcattaaaggctgggacaaccaccaggcacaacgcctgcccagcccgctgtttatcccgggcctgccgcttgccccgatttggcacgaattcatcatcctctccttcatcatcattgtcggactgctgatggcatatatccttgccggcaacattgccaaacccatcagaatcttaggcaacggcatggacagggtggcagaacgagaacttgaagaccgcgtttgccaacaggttcgcgaccgcgacgacgaattggccgatgttgccatgcaattcgacacaatggtggaaaaactggaataa

SEQ ID NO: 1804 - protein, 231 aa, Neisseria gonorrhoeae
MKLFQRIFATFCAVIVCAIFVASFSFWLVQNTLAENQFNQRRTIETTLMGSIISAFKTRGDNGAREILTEWKNSPVSSAVYVIQGDEKKDILNRYIDNYTIERARLFAANNPHSNLVRIEYDRFGEEYLFFIKGWDNHQAQRLPSPLFIPGLPLAPIWHEFIILSFIIIVGLLMAYILAGNIAKPIRILGNGMDRVAERELEDRVCQQVRDRDDELADVAMQFDTMVEKLE

SEQ ID NO: 1805 - DNA, 1407 bp, Neisseria meningitidis
atgaaactgttccaacgcattttcgccacattttgcgcggttatcgtctgtgcaatctttgtggcgagtttttctttctggctggtgcagaacacccttgccgaaaaccagttcaaccaacgccgcaccatcgaaaccactttgatgggcagcatcatttccgcattccgggcacgcggggacgcgggtgcgcgcgaaatcctgacggaatggaaagacagccccgtctcatcgggcgtgtacgttatacagggcgacgagaaaaaagatatcctgaaccggtatatcgacagctataccatcgaacgcgcccggcttttcgccgccggacacccgcattccaacctcgtccatatcgaatacgaccgcttcggcgaagaatacctgttcttcaccaaagactgggacaaactccaagcccgccgcctgcccagccccctgttgatccccggcctgccgctcgccccgatttggcacgaactcatcatattgtccttcatcatcatcgtcggactgctgatggcatatatcctcgccggcaacattgccaaacccatcagaatcttaggcaacggcatggacagggtggcaaacggagaacttgaaacccgtatctcccaacaggtcgacgaccgcgacgacgaattgtcccatcttgccatccaattcgacaaaatggtggaaaaactcgaaaaactcgttgccaaagaacgccacctgctccatcacgtctcccatgaaatgcgttctccccttgcgcgcatgcaggcaattgtcggactgattcaggcgcagccccaaaaacaggagcaatatctcaaacggctggaaggcgaactgacccgcatggatacgctggccggggaactgttaaccctgtcccgtctcgaaacttccaatatggctttggaaaaagaaagcctgaaactcctgcccttcctgggcaacctggtagaagacaatcaaagcattgcccagaaaaacggacaaacggttaccctgtctgccgacggaaaaatccccgaaaacacaaccatccttgccaacgaaagctacctgtaccgcgccttcgacaacgtcatccgcaacgccgtcaactacagtcccgaaggcagcaccatcctgatcaacatcggacaagaccacaaacactggataatcgacgttaccgacaacggccccggcgtggacgaaatgcagctcccgcacatcttcaccgctttctaccgtgcagactccagtgccaacaaacccggaacaggactggggcttgcattgacccaacatattattgaacagcactgcggcaaaatcatcgccgaaaacatcaaaccgaacggtctgcggatgcgctttatcctgcccaagaaaaaaaccggttccaaaacagaaaaaagtgcgaactga

SEQ ID NO: 1806 - protein, 468 aa, Neisseria meningitidis
MKLFQRIFATFCAVIVCAIFVASFSFWLVQNTLAENQFNQRRTIETTLMGSIISAFRARGDAGAREILTEWKDSPVSSGVYVIQGDEKKDILNRYIDSYTIERARLFAAGHPHSNLVHIEYDRFGEEYLFFTKDWDKLQARRLPSPLLIPGLPLAPIWHELIILSFIIIVGLLMAYILAGNIAKPIRILGNGMDRVANGELETRISQQVDDRDDELSHLAIQFDKMVEKLEKLVAKERHLLHHVSHEMRSPLARMQAIVGLIQAQPQKQEQYLKRLEGELTRMDTLAGELLTLSRLETSNMALEKESLKLLPFLGNLVEDNQSIAQKNGQTVTLSADGKIPENTTILANESYLYRAFDNVIRNAVNYSPEGSTILINIGQDHKHWIIDVTDNGPGVDEMQLPHIFTAFYRADSSANKPGTGLGLALTQHIIEQHCGKIIAENIKPNGLRMRFILPKKKTGSKTEKSAN

SEQ ID NO: 1807 - DNA, 1407 bp, Neisseria meningitidis
atgaaactgttccaacgcatcttcgccacattttgcgcggttatcgtctgtgcaatctttgtggcgagtttttctttctggctggtgcagaacacccttgccgaaaaccagttcaaccaacgccgcaccatcgaaaccactttgatgggcagcatcatttccgcattccgggcacgcggggacgcgggtgcgcgcgaaatcctgacggaatggaaagacagccccgtctcatcgggcgtgtacgttatacagggcgacgagaaaaaagatatcctgcaccggtatatcgacagctacaccatcgaacgcgcccggcttttcgccgccggacacccgcattccaacctcgtccatatcgaatacgaccgcttcggcgaagaatacctgttcttcaccaaagactgggacaaactccaagcccgccgcctgcccagccccctgttgatccccggcctgccgctcgccccgatttggcacgaactcatcatattgtccttcatcatcatcgtcggactgctgatggcgtacatcctcgccggcaacattgccaaacccatcagaatcttaggcaacggcatggacagggtggcaaacggagaacttgaaacccgtatctcccaacaggtcgacgaccgcgacgacgaattgtcccatcttgccatccaattcgacaaaatggtggaaaaactcgaaaaactcgttgccaaagaacgccacctgctccatcacgtctcccatgaaatgcgttctccccttgcgcgcatgcaggcaattgtcggactgattcaggcgcagccccaaaaacaggagcaatatctcaaacggctggaaggcgaactgacccgcatggatacgctggccggggaactgttaaccctgtcccgtctcgaaacttccaatatggctttggaaaaagaaagcctgaaactcctgcccttcctgggcaacctggtagaagacaatcaaagcattgcccagaaaaacggacaaacggttaccctgtctgccgacggaaaaatccccgaaaacacaaccatccttgccaacgaaagctacctgtaccgcgccttcgacaacgtcatccgcaacgccgtcaactacagtcccgaaggcagcaccatcctgatcaacatcggacaagaccacaaacactggataatcgacgttaccgacaacggccccggcgtggacgaaatgcagctcccgcacatcttcaccgctttctaccgtgcagactccagtgccaacaaacccggaacaggactggggcttgcattgacccaacatattattgaacagcactgcggcaaaatcatcgccgaaaacatcaaaccgaacggtctgcggatgcgctttatcctgcccaagaaaaaaaccggttccaaaacagaaaaaagtgcgaactga

SEQ ID NO: 1808 - protein, 468 aa, Neisseria meningitidis
MKLFQRIFATFCAVIVCAIFVASFSFWLVQNTLAENQFNQRRTIETTLMGSIISAFRARGDAGAREILTEWKDSPVSSGVYVIQGDEKKDILHRYIDSYTIERARLFAAGHPHSNLVHIEYDRFGEEYLFFTKDWDKLQARRLPSPLLIPGLPLAPIWHELIILSFIIIVGLLMAYILAGNIAKPIRILGNGMDRVANGELETRISQQVDDRDDELSHLAIQFDKMVEKLEKLVAKERHLLHHVSHEMRSPLARMQAIVGLIQAQPQKQEQYLKRLEGELTRMDTLAGELLTLSRLETSNMALEKESLKLLPFLGNLVEDNQSIAQKNGQTVTLSADGKIPENTTILANESYLYRAFDNVIRNAVNYSPEGSTILINIGQDHKHWIIDVTDNGPGVDEMQLPHIFTAFYRADSSANKPGTGLGLALTQHIIEQHCGKIIAENIKPNGLRMRFILPKKKTGSKTEKSAN

SEQ ID NO: 1809 - DNA, 630 bp, Neisseria gonorrhoeae
atggcagcccatctcgaagaacaacaagagttagacaactttaaatatttttggaaaaccacgggcaaatggctgtttgccctgctgattttggcggcactcggctacttgggatacacggtttaccaaaaccgtgcggcttcccaaaatcaggaagcggcggcggtgctggcaaacatcgtggaaaaggcgcaaaacaaagccccgcaaagcgaaatcaatgccgaactgtccaaactccaacaaagctacccccattccatttccgccgcccaagccacgctgatggcggcggcaaccgaatttgacgcgcagcgttacgatgttgccgaaggtcatttgaaatgggtgttgtccaaccaaaaagacagcctgattcaggcgttggcggcgcagcgtctgggcgttgtgttgttgcaacaaaaaaaatacgatgccgcgcttgccgcactcgacacgccggttgaggcggacttcgcccccctgctgatggaaactaaaggcgatgtttatgccgcacaggaaaaaagccaggaagccttaaaaaactacggacaggctttggaaaaaatgcctcaagattctgtcggtcgcgaattgcttcaaatgaaactcgattcgctgaaataa

SEQ ID NO: 1810 - protein, 209 aa, Neisseria gonorrhoeae
MAAHLEEQQELDNFKYFWKTTGKWLFALLILAALGYLGYTVYQNRAASQNQEAAAVLANIVEKAQNKAPQSEINAELSKLQQSYPHSISAAQATLMAAATEFDAQRYDVAEGHLKWVLSNQKDSLIQALAAQRLGVVLLQQKKYDAALAALDTPVEADFAPLLMETKGDVYAAQEKSQEALKNYGQALEKMPQDSVGRELLQMKLDSLK

SEQ ID NO: 1811 - DNA, 630 bp, Neisseria meningitidis
atggcagcccatctcgaagaacaacaagagttagacaactttaaatatttttggaaaaccacgggcaaatggctgtttgccttgctgattttggcggcactcggctacttgggatacacggtttaccaaaaccgtaaagtttcccaaaatcaggaagcggcggcggtgctggcaaacatcgtagaaaaggcgcaaagcaaagccccgcaaagcgaaatcaatgccgaattgaccaaactccaacaaagctacccgcattccatttccgccgcccaagccacactgatggcggcggcaaccgaatttgacgcgcagcgttacgatgttgccgaaggccatttgaaatgggtgttgtccaaccaaaaagacagcctgattcaagcgttggcggcgcagcgtctgggcgttgtgttgttgcaacaaaaaaaatacgatgccgcgcttgccgcgctcgatacgccggttgaagcggacttcgcccccctgctgatggaaaccaaaggcgatgtctatgccgcacagggaaaaagccaggaagccttaaaaaactacggacaggctttagaaaaaatgcctcaagattctgtcggtcgcgaattggttcaaatgaaacttgattcgctgaaataa

SEQ ID NO: 1812 - protein, 209 aa, Neisseria meningitidis
MAAHLEEQQELDNFKYFWKTTGKWLFALLILAALGYLGYTVYQNRKVSQNQEAAAVLANIVEKAQSKAPQSEINAELTKLQQSYPHSISAAQATLMAAATEFDAQRYDVAEGHLKWVLSNQKDSLIQALAAQRLGVVLLQQKKYDAALAALDTPVEADFAPLLMETKGDVYAAQGKSQEALKNYGQALEKMPQDSVGRELVQMKLDSLK

SEQ ID NO: 1813 - DNA, 630 bp, Neisseria meningitidis
atggcagcccatttggaagaacaacaagagttggacaactttaaatatttttggaaaaccacgggcaaatggctgtttgccgtgctgattttggcggcactcggctacttgggatacacggtttaccaaaaccgtgcggcttcccaaaatcaggaagcggcggcggtgctggcaaacatcgtggaaaaggcgcaaaacaaagccccgcaaagcgaaatcaatgccgaattggccaagctccaacaaagctacccccattccatttccgccgcccaagccacgctgatggcggcagcaaccgaatttgacgcgcagcgttacgatgttgccgaaggccatttgaaatgggtattgtccaaccaaaaagacagcctgatccaggcgttggcggcgcagcgtctgggcgttgtgttgttgcaacaaaaaaaatacgatgccgcgcttgccgcactcgacacgccggttgaagcggacttcgcccccctgctgatggaaaccaaaggcgatgtctatgccgcacagggaaaaagccaggaagccttaaaaaactacggacaggctttagaaaaaatgcctcaagattctgtcggtcgcgaattggttcaaatgaaacttgattcgctgaaataa

SEQ ID NO: 1814 - protein, 209 aa, Neisseria meningitidis
MAAHLEEQQELDNFKYFWKTTGKWLFAVLILAALGYLGYTVYQNRAASQNQEAAAVLANIVEKAQNKAPQSEINAELAKLQQSYPHSISAAQATLMAAATEFDAQRYDVAEGHLKWVLSNQKDSLIQALAAQRLGVVLLQQKKYDAALAALDTPVEADFAPLLMETKGDVYAAQGKSQEALKNYGQALEKMPQDSVGRELVQMKLDSLK

SEQ ID NO: 1815 - DNA, 543 bp, Neisseria gonorrhoeae
atgaaacgtatctttttgcccgccttgcccgccatcctgcctttatccgcttatgccgacctgcccttgacgattgaagacataatgaccgacaagggaaaatggaaactggaaacttcccttacctatctgaatagcgaaaacagccgcgccgcacttgccgcaccggtttacattcaaaccggcgcaacctcgtttatccccattccgaccgaaattcaagaaaacggcagcaataccgatatgctcgccggcacgctcggtttgcgctacggactgaccggcaataccgacatttacggcagcggcagctatctgtggcacgaagaacgcaaactcgacggcaacggcaaaacccgcaacaaacggatgtccgacatatccgccggcatcagccacaccttccttaaagacggcaaaaaccccgccctaatcagctttcttgaaagcacggtttacgaaaaatcgcgcaacaaagcctcgttaatcaaaaaaagggggctttgccccttttataacttaaggataaattatgaatattaa

SEQ ID NO: 1816 - protein, 180 aa, Neisseria gonorrhoeae
MKRIFLPALPAILPLSAYADLPLTIEDIMTDKGKWKLETSLTYLNSENSRAALAAPVYIQTGATSFIPIPTEIQENGSNTDMLAGTLGLRYGLTGNTDIYGSGSYLWHEERKLDGNGKTRNKRMSDISAGISHTFLKDGKNPALISFLESTVYEKSRNKASLIKKRGLCPFYNLRINYEY

SEQ ID NO: 1817 - DNA, 870 bp, Neisseria meningitidis
atgaagcgcatctttttgcccgccttgcccgccatcctgcctttatccacttatgccgacctgcccttgacgattgaagacataatgaccgacaagggaaaatggaaactggaaacttcccttacctacctgaacagcgaaaacaaccgcgccgaacttgccgcaccggtttacattcaaaccggcgcaacctcgtttatccccattccgaccgaaatccaagaaaacggcagcaataccgatatgctcgtcggcacgctcggtttgcgctacggactgaccgggaataccgacatttacggcagcggcagctatctgtggcacgaagaacgcaaactcgacggcaacagcaaaacccgcaacaaacggatgtccgacgtatccctcggcatcagccacactttccttaaagacgacaaaaaccccgccctaatcagctttcttgaaagcacggtttacgaaaaatcgcgcaacaaagcctcgtcgggaaaatcctggctcatcggcgccaccacctacaaagccatagatccgattgtcctttccctcaccgccgcctaccgcatcaacggcagcaaaaccctttcagacggcatccgctacaaatcgggcaactacctgctgctcaaccccaacatctcatttgctgccaacgacagaatcagcctgaccggaggcatccaatggctgggcaggcagcccgaccggacggacggcaaacgggaatcctccagaaacacatccacctacgcccatttcggcgcaggtttcggtttcaccaaaaccacggctttaaacgcatccgcacgtttcaacgtttcagggcaaagcagttccgaactgaaatttggcgtacagcatacattttaa

SEQ ID NO: 1818 - protein, 289 aa, Neisseria meningitidis
MKRIFLPALPAILPLSTYADLPLTIEDIMTDKGKWKLETSLTYLNSENNRAELAAPVYIQTGATSFIPIPTEIQENGSNTDMLVGTLGLRYGLTGNTDIYGSGSYLWHEERKLDGNSKTRNKRMSDVSLGISHTFLKDDKNPALISFLESTVYEKSRNKASSGKSWLIGATTYKAIDPIVLSLTAAYRINGSKTLSDGIRYKSGNYLLLNPNISFAANDRISLTGGIQWLGRQPDRTDGKRESSRNTSTYAHFGAGFGFTKTTALNASARFNVSGQSSSELKFGVQHTF

SEQ ID NO: 1819 - DNA, 870 bp, Neisseria meningitidis
atgaagcgcatctttttgcccgccttgcccgccatcctgcctttatccgcttatgccgacctgcccttgacgattgaagacataatgaccgacaagggcaaatggaaactggaaacttcccttacctacctgaacagcgaaaacaaccgcgccgaacttgccgcaccggtttacatccaaaccggcgcaacctcgtttatccccattccgaccgaaatccaagaaaacggcagcaataccgatatgctcgttggcacgctcggtttgcgctacggactgaccgggaataccgacatttacggcagcggcagctatctgtggcacgaagaacgcaaactcgacggcaacggcaaaacccgaaacaaacggatgtccgacgtatccctcggcatcagccacaccttccttaaagacgacaaaaaccccgccctaatcagctttcttgaaagcacggtttacgaaaaatcgcgcaacaaagcctcgtcgggaaaatcctggctcatcggcgccaccacctacaaagccatcgaccccgtcgtcctctcattgaccgctgcctaccgtatcaacggcagcaaaaccctttcaagcaacaccaaatacaaagcaggcaattactggatgctgaatcccaatatatccttcgccgccaacgacagaatcagcctcacgggcggcatccaatggctgggcaagcagcccgaccgtctggacggcaaaaaagaatccgcaagaaacacatccacctatgcccatttcggcgcaggtttcggtttcaccaaaaccacggctttaaacgcatccgcacgtttcaacgtttcagggcaaagcagttccgaactgaaatttggcgtacagcatacgttttaa

SEQ ID NO: 1820 - protein, 289 aa, Neisseria meningitidis
MKRIFLPALPAILPLSAYADLPLTIEDIMTDKGKWKLETSLTYLNSENNRAELAAPVYIQTGATSFIPIPTEIQENGSNTDMLVGTLGLRYGLTGNTDIYGSGSYLWHEERKLDGNGKTRNKRMSDVSLGISHTFLKDDKNPALISFLESTVYEKSRNKASSGKSWLIGATTYKAIDPVVLSLTAAYRINGSKTLSSNTKYKAGNYWMLNPNISFAANDRISLTGGIQWLGKQPDRLDGKKESARNTSTYAHFGAGFGFTKTTALNASARFNVSGQSSSELKFGVQHTF

SEQ ID NO: 1821 - DNA, 390 bp, Neisseria gonorrhoeae
atgcttaaacatctcgcattcctactgcccgccatgatgttcgccctccccgcccagaccgccgtcctaagcccctatcaggaaaccggctgcacctacgaaggcgggatcggaaaagacgggcttccttcaggcaaaggcatatggcgttgccgggatgggcgcggttataccggttcattcaaaaacggcaaattcgacgggcaaggcgtttataccgttgccgccggccgcgaagtatttctcgagccgttcaattccgacagtaccaaattccgcaatatggcattgtcgggcacgttcaaacaaggcttggcacacggcaggttcgccgcctcgcaaaacggcgaaaccctcttttattatgaaatgcgaacacggcatgattaa

SEQ ID NO: 1822 - protein, 129 aa, Neisseria gonorrhoeae
MLKHLAFLLPAMMFALPAQTAVLSPYQETGCTYEGGIGKDGLPSGKGIWRCRDGRGYTGSFKNGKFDGQGVYTVAAGREVFLEPFNSDSTKFRNMALSGTFKQGLAHGRFAASQNGETLFYYEMRTRHD

SEQ ID NO: 1823 - DNA, 417 bp, Neisseria meningitidis
atgcttaaacatctcgcattcctactgcccgccatgatgttcgccctccccacttcggccgccgtcctgacttcctatcaagaaccaggctgcacctacgacggcaatgtcggcaaagacggtaaacccgccggcaaaggcacatggcgctgccaagacgggcgcaactataccggttcgtttaaaaacggcaaattcgacgggcaaggcgtttataccgttgccgccaaccgcgaaatatttatcgaaccgttcaattccgacagtaccaaattccgcaacatggtactctcgggcacgttcaaaaaaggcttggcacacggcagatttaccgtctcgcaaaacggcgaaaccctcttcattatgaaatgcgaaaacggcatgattaaagaagtgaaactgcccaaaaacaaataa

SEQ ID NO: 1824 - protein, 138 aa, Neisseria meningitidis
MLKHLAFLLPAMMFALPTSAAVLTSYQEPGCTYDGNVGKDGKPAGKGTWRCQDGRNYTGSFKNGKFDGQGVYTVAANREIFIEPFNSDSTKFRNMVLSGTFKKGLAHGRFTVSQNGETLFIMKCENGMIKEVKLPKNK

SEQ ID NO: 1825 - DNA, 417 bp, Neisseria meningitidis
atgcttaaacatctcgcattcctactgcccgccatgatgttcgccctccccgccgcgtccgccgttctgacttcctatcaagaacccggctgcacctacgaaggcgatgtcggcaaagacggtaaacccgccggcaaaggcacatggcgctgccaagacgggcgcaactataccggttcgtttaaaaatggcaaattcgacggacaaggcgtttataccgttgccgccaaccgcgaaatatttatcgaaccgttcaattccgacagtaccaaattccgcaacatggtactctcgggcacattcaaaaaaggcttggcacacggcagatttaccgtctcgcaaaacggcgaaaccctcttcattatgaaatgcgaaaacggcatgattaaagaagtgaagctgcccaaaaacaaataa

SEQ ID NO: 1826 - protein, 138 aa, Neisseria meningitidis
MLKHLAFLLPAMMFALPAASAVLTSYQEPGCTYEGDVGKDGKPAGKGTWRCQDGRNYTGSFKNGKFDGQGVYTVAANREIFIEPFNSDSTKFRNMVLSGTFKKGLAHGRFTVSQNGETLFIMKCENGMIKEVKLPKNK

SEQ ID NO: 1827 - DNA, 2178 bp, Neisseria gonorrhoeae
atgcaacaaaaaatccgtttccaaatcgaggcgatgacctgtcaggcatgtgcttcgcgcattgaaaaagtgttgaacaaaaaagattttgtcgaatcggcgggagtgaactttgccagtgaggaagcgcaggttacgtttgacggcagcaaaacctcggttgccgacattgccaaaatcattgagaaaaccggttacggcgcgaaggaaaaaacggaagatacattgccgcaacctgaagcagaacaccatatcggctggcggttgtggcttttgctgaccatcaatatcccgttccttatcggtatggtagggatgatgctaaaagggctgaattggacacggcacgattggatgattccgcctgtatggcagtttgtactggcaagcatagtgcaactttggctggcaatcccgttttacaaaagcgcgtgggcaagcattaaaggcgggctggcgaatatggacgtactcgttaccatcggcacggtgtcgatttacctgtattccgtttatatgctgtttttcagttcgcatgcggcgcacggtatggcgcatgtgtattttgaagcgggcgtgatggtgatcggttttgtgtcgctgggtaagtttttggaacaccgcaccaaaaaatccagcctgaacagcttgggcttactgctaaaactcacgccgacccaagtcaacgtgcaacgcaacggcgaatggaaacaactgcccatcgaccaagtgcaaatcggcgaccttatccgcaccaaccacggcgaacgcatcgctgccgacggcattatcgaaagcggcagcggttgggcggacgaaagccaccttaccggcgaatccaatcccgaagagaaaaaggcgggcggcaaagtgttggcgggcgcgctgatgaccgaaggcagcgtggtgtaccgcgccgcgcagctcggcagccaaaccctgctcggcgacatgatgaacgcgctctctgaagcacaaggcagtaaagcaccgattgcgcgcgtggccgataaagcggcggcggtatttgtgccaactgtcgtgggcatcgcgcttctgacttttatcgttgcttggctgattaagggcgattggacggtcgcactgatgcacgccgttgccgttttggtgattgcctgcccgtgcgcgctcggtctggcgacccctgccgcgattatggtcggcatgggcaaagcggtgaaacacggcatttggtttaaagacgcggcggcaatggaggaagcagcccacgtcgatgccgtcgtattggacaaaaccggtacgctgaccgaaggcaggccgcaggttgccgccgtttattacgttcccgacagcggctttgacgaagacgctttgtaccgcatcgccgccgccgtcgagcaaaacgccgcccacccgctcgcccgcgccatcgtctccgccgcacaagcgcgcggtttggagattcccgctgcacaaaatgcgcaaaccgttgtcggagcaggcattaccgccgaagtggaaggcgtgggtttggtgaaatcaggcaaagccgaatttgccgaactgaccttgccgaagttttcagacggcgtttgggaaatcgccagtgcggttaccgtatctgtaaacggcaaaccgatcggcgcattcgcactctccgacgcgttgaaagccgataccgccgaagccataggccgtctgaaaaaacacaatatcgatgtctatattatgagcggcgataaccaaagtacggtcgaatacgtcgccaaacaactgggcatcgcacacgccttcggtaatatgagtccgtgcgacaaagccgccgaagtgcagaaactcaaagccgccggcaaaaccgtggcgatggtcggcgacggcatcaacgacgcgcccgcgcttgccgccgccaacgtcagcttcgccatgaaaggcggtgcggacgttgccgaacacaccgcctccgccacgctgatgcagcattcggtcaatcagctcgccgatgccctgctgatatcgcaggcaacgttggaaaacatcaagcaaaacctatttttcgccttcttctacaatatattgggcattccgctcgccgcgctcggctttttaaatcccgtcatagcaggcgcggcaatggcggcaagctcggtttcggtattgggcaatgccctgcgcctgaaatgggtaaaaatcgattga

SEQ ID NO: 1828 - protein, 725 aa, Neisseria gonorrhoeae
MQQKIRFQIEAMTCQACASRIEKVLNKKDFVESAGVNFASEEAQVTFDGSKTSVADIAKIIEKTGYGAKEKTEDTLPQPEAEHHIGWRLWLLLTINIPFLIGMVGMMLKGLNWTRHDWMIPPVWQFVLASIVQLWLAIPFYKSAWASIKGGLANMDVLVTIGTVSIYLYSVYMLFFSSHAAHGMAHVYFEAGVMVIGFVSLGKFLEHRTKKSSLNSLGLLLKLTPTQVNVQRNGEWKQLPIDQVQIGDLIRTNHGERIAADGIIESGSGWADESHLTGESNPEEKKAGGKVLAGALMTEGSVVYRAAQLGSQTLLGDMMNALSEAQGSKAPIARVADKAAAVFVPTVVGIALLTFIVAWLIKGDWTVALMHAVAVLVIACPCALGLATPAAIMVGMGKAVKHGIWFKDAAAMEEAAHVDAVVLDKTGTLTEGRPQVAAVYYVPDSGFDEDALYRIAAAVEQNAAHPLARAIVSAAQARGLEIPAAQNAQTVVGAGITAEVEGVGLVKSGKAEFAELTLPKFSDGVWEIASAVTVSVNGKPIGAFALSDALKADTAEAIGRLKKHNIDVYIMSGDNQSTVEYVAKQLGIAHAFGNMSPCDKAAEVQKLKAAGKTVAMVGDGINDAPALAAANVSFAMKGGADVAEHTASATLMQHSVNQLADALLISQATLENIKQNLFFAFFYNILGIPLAALGFLNPVIAGAAMAASSVSVLGNALRLKWVKID

SEQ ID NO: 1829 - DNA, 2163 bp, Neisseria meningitidis
atgcaacaaaaaatccgtttccaaatcgaaggcatgacctgccaggcctgcgcttcgcgcattgaaaaagtgttgaacaaaaaagattttgtcgaatcggcgggggtaaacttcgccagcgaagaggcgcaggtagtgtttgacgacagcaaaacctcagtagccgacattgccaaaatcattgagaaaaccggttacggcgcgaaggaaaaaacggaagatacattgccgcaacccgaagcagaacaccatatcggctggcggctgtggctgctgttcaccatcaacgtcccgttccttatcggcatggcggggatgatgatcggcagacacgattggatgattccgccgttgtggcagttcgcattggcaagcgtggtgcagctttggctggcaatcccgttttacaaaagcgcgtgggcgagcattaagggcggactggcgaatatggacgtgctggttaccatcggcacggtctcgatttacctgtattccgtctatatgctgtttttcagcccgcacgcggcgtacggtatggcgcatgtgtattttgaagtgggcgtgatggtgatcggttttgtgtcactgggtaaatttttggaacaccgtaccaaaaaatccagcctcaacagcttgggcttgctgctcaaacttacaccaacccaagtcaacgtgcaacgcaacggcgaatggaaacagcttcccatcgaccaagtgcaaatcggcgaccttatccgcgccaaccacggcgaacgcattgccgcagacggcatcattgaaagcggcagcggttgggcggacgagagccatcttaccggcgaatccaatcctgaagaaaaaaaggcgggcggcaaagtgttggcgggcgcgttaatgaccgaaggcagtgtggtgtaccgcgccacgcagctcggcagccaaacccagctcggcgacatgatgaacgcgctctctgaagcacaaggcagtaaagcaccgattgcgcgcgtagccgataaagcggctgcggtattcgtgcctgccgtcgtgggcattgcgttgttgacttttattgttacttggctgattaagggcgattggacggttgcgctgatgcacgccgtcgccgttttggtgattgcctgcccgtgcgcgctgggtctggcaacccctgccgcgattatggtcggtatgggcaaagcggttaaacacggtatttggtttaaagacgcggcagcaatggaggaagccgcccacgtcgatgccgtcgtgttggacaaaaccggtacgctgaccgaaggcagcccgcaggttgccgccgtttattgcgttcccgacagcggctttgacgaagacgctttgtaccgcatcgccgccgccgtcgaacaaaacgccgcccatccgctcgcccgtgccatcgtctccgccgcccaagcgcgcggtttggacattcccgccgcacaaaacgcacaaaccgttgtcggcgcaggcattaccgccgaagtggaaggcgtgggtttggtgaaagcaggcaaagccgaatttgccgaactggccttgccgaagtttttagacggcgtttgggatattgcaagcattgttgcggtctcagtcgataacaaacccatcggcgcattcgcacttgccgacgcgttgaaagccgataccgccgaagccataggccgtctgaaaaaacacaatatcgatgtctatattatgagcggcgacaaccaaggcacggtcgaatacgtcgccaaacaactgggcatcgcacacgccttcggcaacatgagtccgcgcgataaagctgccgaagtgcaaaaactcaaagccgccggcaaaaccgtggcgatggtcggcgacggcatcaacgacgcgcccgcgcttgccgccgctaacgtcagcttcgccatgaaaggcggagcggacgttgccgaacataccgcatccgccacgctgatgcagcattcggtcaaccaactcgccgatgctctgctggtgtcgcaagccactttgaaaaacatcaagcaaaacctgtttttcgccttcttctacaatattttgggcattcctctcgccgcgcttggctttttaaatcccgtcatcgctggcgcggcaatggcggcaagctcggtttccgtgttgagcaatgccttgcgcctgaaacgggtaaaaatcgattag

SEQ ID NO: 1830 - protein, 720 aa, Neisseria meningitidis
MQQKIRFQIEGMTCQACASRIEKVLNKKDFVESAGVNFASEEAQVVFDDSKTSVADIAKIIEKTGYGAKEKTEDTLPQPEAEHHIGWRLWLLFTINVPFLIGMAGMMIGRHDWMIPPLWQFALASVVQLWLAIPFYKSAWASIKGGLANMDVLVTIGTVSIYLYSVYMLFFSPHAAYGMAHVYFEVGVMVIGFVSLGKFLEHRTKKSSLNSLGLLLKLTPTQVNVQRNGEWKQLPIDQVQIGDLIRANHGERIAADGIIESGSGWADESHLTGESNPEEKKAGGKVLAGALMTEGSVVYRATQLGSQTQLGDMMNALSEAQGSKAPIARVADKAAAVFVPAVVGIALLTFIVTWLIKGDWTVALMHAVAVLVIACPCALGLATPAAIMVGMGKAVKHGIWFKDAAAMEEAAHVDAVVLDKTGTLTEGSPQVAAVYCVPDSGFDEDALYRIAAAVEQNAAHPLARAIVSAAQARGLDIPAAQNAQTVVGAGITAEVEGVGLVKAGKAEFAELALPKFLDGVWDIASIVAVSVDNKPIGAFALADALKADTAEAIGRLKKHNIDVYIMSGDNQGTVEYVAKQLGIAHAFGNMSPRDKAAEVQKLKAAGKTVAMVGDGINDAPALAAANVSFAMKGGADVAEHTASATLMQHSVNQLADALLVSQATLKNIKQNLFFAFFYNILGIPLAALGFLNPVIAGAAMAASSVSVLSNALRLKRVKID

SEQ ID NO: 1831 - DNA, 2178 bp, Neisseria meningitidis
atgcaacaaaaagtccgtttccaaatcgaaggcatgacctgccaggcatgtgcttcgcgcattgaaaaagtgttgaacaaaaaagattttgtcgaatcggcgggggtaaacttcgccagcgaagaggctcaggtagtgtttgacgacagcaaaacctcagtagccgacattgccaaaatcattgagaaaaccggttacggcgcgaaggaaaaaacggaagatacattgccgcaacccgaagcagaacaccatatcggctggaggttgtggcttttgctggccatcaatatcccgttccttatcggtatggtagggatgatgctaaaagggctgaattggacacggcatgattggatgttgtcgcccttgttgcagtttgcattggcgagtgtggtgcagctttggctggcggtgccattttacaaaagcgcgtgggcgagcattaaaggcgggctggcgaatatggacgtactcgttaccatcggcacggtctcgatttacctgtattccgtctatatgctgtttttcagcccgcacgcggcgtacggtatggcgcatgtgtattttgaagtaggcataatggtgattggttttgtgtcactgggtaaatttttggaacaccgcaccaaaaaatccagcctgaacagcttgggcttgctgctcaaactcacgccaacccaagtcaacgtgcaacgcgatggcgaatggcggcagctacccatcgaccaagtgcaaatcggcgacctaatccgcgccaatcacggcgaacgcattgccgccgacggcatcatagaaagcggcagcggctgggcggacgaaagccatcttaccggcgaatccaatcccgaagagaaaaaggcaggcggcaaagtattggcgggcgcgctgatgactgaaggcagcgtggtgtaccgcgccgcgcagctcggcagccaaaccctgctcggcgacatgatgaacgcgctctccgaagcgcaaggcagtaaagcaccgattgcgcgtgtggcggacaaggcggcggcggtattcgtgcctgccgttgtgggcatcgcacttttgacttttatcgctacttggctgattaagggcgattggacgctcgcattgatgcacgccgtcgccgttttggtgattgcctgcccgtgtgcactcggtttggcaacccctgctgcgattatggtcggtatgggcaaagcggttaaacacggtatttggtttaaagacgcggcagcaatggaagaagccgcccacgttgatgccgtcgtgctggacaaaaccggcacgctgaccgaaggcaagccgcaggttgccgccgtttattgtgttcccgacagcggctttgacgaagacgctttgtaccgcatcgccgccgccgtcgaacaaaacgccgcccatccgctcgcccgtgccatcgtctccgccgcccaggcgcgcggtttggagattcccaccgcacaaaatgcccaaaccattgtcggcgcgggcattaccgccgaagtaaaaggcgcgggtttggtaaaagcaggcaaagccgaatttgccgaactgaccttgccgaagttttcagacggcgtttgggaaatcgccagtgtggttgccgtatctgtaaacggcaaacctatcggcgcattcgcactcgccgacgcgttgaaagccgataccgccgaagccataggccgtctgaaaaaacacaatatcgatgtctatattatgagcggcgataaccaaggcacggtcgagtacgtcgccaaacaactgggcatcgcacacgccttcggtaatatgagtccgcgcgacaaagccgccgaagtgcagaaactcaaagccgccggcaaaaccgtggcgatggtcggcgacggcatcaacgacgcgcccgcgctcgccgccgccaacgtcagcttcgccatgaaaggcggtgcagacgttgccgaacacaccgcatccgccacactgatgcagcattcggtcaaccagctcgccgatgcgctatcggtatcgcgagcgacgttgaaaaacatcaagcaaaacctgtttttcgccttcttctacaatattttgggcattccgctcgccgcgctcggctttttaaaccccgtcatcgcaggcgcggcaatggcggcaagctcggtttccgtgttgagcaacgccttgcgcctgaaacgggtaaaaatcgattga

SEQ ID NO: 1832 - protein, 725 aa, Neisseria meningitidis
MQQKVRFQIEGMTCQACASRIEKVLNKKDFVESAGVNFASEEAQVVFDDSKTSVADIAKIIEKTGYGAKEKTEDTLPQPEAEHHIGWRLWLLLAINIPFLIGMVGMMLKGLNWTRHDWMLSPLLQFALASVVQLWLAVPFYKSAWASIKGGLANMDVLVTIGTVSIYLYSVYMLFFSPHAAYGMAHVYFEVGIMVIGFVSLGKFLEHRTKKSSLNSLGLLLKLTPTQVNVQRDGEWRQLPIDQVQIGDLIRANHGERIAADGIIESGSGWADESHLTGESNPEEKKAGGKVLAGALMTEGSVVYRAAQLGSQTLLGDMMNALSEAQGSKAPIARVADKAAAVFVPAVVGIALLTFIATWLIKGDWTLALMHAVAVLVIACPCALGLATPAAIMVGMGKAVKHGIWFKDAAAMEEAAHVDAVVLDKTGTLTEGKPQVAAVYCVPDSGFDEDALYRIAAAVEQNAAHPLARAIVSAAQARGLEIPTAQNAQTIVGAGITAEVKGAGLVKAGKAEFAELTLPKFSDGVWEIASVVAVSVNGKPIGAFALADALKADTAEAIGRLKKHNIDVYIMSGDNQGTVEYVAKQLGIAHAFGNMSPRDKAAEVQKLKAAGKTVAMVGDGINDAPALAAANVSFAMKGGADVAEHTASATLMQHSVNQLADALSVSRATLKNIKQNLFFAFFYNILGIPLAALGFLNPVIAGAAMAASSVSVLSNALRLKRVKID

SEQ ID NO: 1833 - protein, 1551 aa, Neisseria gonorrhoeae
ATGAAAAAACCTTTGATTTCAGTTGCGGCAGTATTGCTCGGCGTTGCTTTGGGTACACCTTATTATTTGGGTGTCAAAGCAGAAGAAAGTCTGACGCAGCAGCAAAAAATATTGCAGAAAACGGGCTTTTTGACCGTCGAATCGCACCAGTATGATCGAGGCTGGTTTACCTCTACGGAAACGACGGTCATCCGTCTGAAACCCGAGTTGCTGCATAATGCGCAGAAATACCTGCCGGATAACTTGAAAATAGTGTTGGAACAGCCGGTTACGCTGGTAAACCATATCACGCACGGCCCTTTCGCCGGCGGATTCGGCACGCAGGCGCACATTGAAACCGAGTTCAAATACGCGCCTGAAACGGAAAAAGTTTTGGAACGCTTTTTTGGGAAACAAGTTCCGGTTTCCCTTGCCAATACCGTTTATTTCAACGGCAGCGGTAAAATGGAAGTCAGTGTTCCCGCTTTCGATTATGAAGAACTGTCGGGCATCAGGCTGCACTGGGAAGGCCTGACGGGGGAAACGGTTTATCAAAAAGGTTTCAAAAGCTACCGCAACAGCTATGATGCGCCCTTGTTCAAAATCAAGCTGGCAGACAAAGGCGATGCCGCGTTTGAAAAAGCGCATTTCGATTCGGAAACTTCAGACGGCATCAATCCGCTTGCTTTGGGCAGCAGCAATCTGACTTTGGAAAAATTTTCGCTCGAATGGAAAGAGGGTGTCGATTACAACGTCAAATTGAACGAACTGGTCAACCTCGTTACCGATTTGCAGATCGGCGCGTTTATCAATCCCAACGGCAGCATCGCACCTTCCAAAATCGAAGTCGGCAAGCTGGCTTTTTCAACCAAGACCGGGGAATCGGGCGCGTTTATCGACAGCGAAGGGCGGTTCCGTTTCGATACGTTGGTGTACGGCGATGAAAAATACGGCCCGCTGGACATCCATATCGCTGCCGAACACCTCGATGCTTCTGCCTTAACCGTATTGAAACGCAAGTTTGCACAAATTTCTGCCAAAAAAATGACTGAGGAACAAATCCGCAATGATTTGATTGCGGCAGTCAAAGGCGATGCTTCCGGATTATTTACCCATGACCCGGTACTAAATATCAAAATTTTCCGTTTCACCCTGCCTCAGGGAAAAATTGATGTGGGCGGAAAAATCATGTTTAAAGGCATGAAGAAGGAAGATTTGAACCAATTGGGACTGATGTTAAAGAAAACCGAGGCAAACATCAGAATGAGTATTCCTCAAAAAATGTTGGAAGATTTGGCGGTAAGTCAGGCTGGAAATATTTTCAGTGTAAATGCCGAAGATGAGGCGGAAGCCAGAGCAAGCATTGCCGATATTAATGAAACATTGCGCCTGATGGTGGACAGTACGGTCCAAAGTATGGCAAGGGAAAAATATCTTACTTTAGACGGTAATCAGATTGATACGGTCATTTCCCTTAAAAACAACGCCCTGAAGTTAAACGGGAAAACGCTGCAAAATGAACCCGATCCTGATTTTGACGAGGGAGATATGGTTTCCGGCCAGCCGCATTAA

SEQ ID NO: 1834 - protein, 516 aa, Neisseria gonorrhoeae
MKKPLISVAAVLLGVALGTPYYLGVKAEESLTQQQKILQKTGFLTVESHQYDRGWFTSTETTVIRLKPELLHNAQKYLPDNLKIVLEQPVTLVNHITHGPFAGGFGTQAHIETEFKYAPETEKVLERFFGKQVPVSLANTVYFNGSGKMEVSVPAFDYEELSGIRLHWEGLTGETVYQKGFKSYRNSYDAPLFKIKLADKGDAAFEKAHFDSETSDGINPLALGSSNLTLEKFSLEWKEGVDYNVKLNELVNLVTDLQIGAFINPNGSIAPSKIEVGKLAFSTKTGESGAFIDSEGRFRFDTLVYGDEKYGPLDIHIAAEHLDASALTVLKRKFAQISAKKMTEEQIRNDLIAAVKGDASGLFTHDPVLNIKIFRFTLPQGKIDVGGKIMFKGMKKEDLNQLGLMLKKTEANIRMSIPQKMLEDLAVSQAGNIFSVNAEDEAEARASIADINETLRLMVDSTVQSMAREKYLTLDGNQIDTVISLKNNALKLNGKTLQNEPDPDFDEGDMVSGQPH

SEQ ID NO: 1835 - DNA, 1388 bp, Neisseria meningitidis
tggtttacctctatggaaacgacggtcatccgtctgaaacccgagttgctgaataatgcccgaaaatacctgccggataacctgaaaacagtgttggaacagccggttacgctggttaaccatatcacgcacggccctttcgccggcggattcggcacgcaggcgtacattgaaaccgagttcaaatacgcgcctgaaacggaaaaagttctggaacgcttttttggaaaacaagtcccggcttcccttgccaataccgtttattttaacggcagcggtaaaatggaagtcagtgttcccgccttcgattatgaagagctgtcgggcatcagctgcactgggaakgcctgacgggagaaacggtttatcaaaaaggtttcaaaagctaccggaacggctatgatgcccccttgtttaaaatcaagctggcagacaaaggcgatgccgcgtttgaaaaagtgcatttcgattcggaaacttcagacggcatcaatccgcttgctttgggcagcagcaatctgaccttggaaaaattctccctagaatggaaagagggtgtcgattacaacgtcaagttaaacgaactggtcaatcttgttaccgatttgcagattggcgcgtttatcaatcccaacggcagcatcgcaccttccaaaatcgaagtcggcaaactggctttttcaaccaagaccggggaatcaggcgcgtttatcaacagtgaagggcagttccgtttcgatacactggtgtacggcgatgaaaaatacggcccgctggacatccatatcgctgccgaacacctcgatgcttctgccttaaccgtattgaaacgcaagtttgcacaaatttccgccaaaaaaatgaccgaggaacaaatccgcaatgatttgattgccgccgtcaaaggagaggcttccggactgttcaccaacaatcccgtattggacattaaaactttccgattcacgctgccatcgggaaaaatcgatgtgggcggaaaaatcatgtttaaagacatgaagaaggaagatttgaatcaattgggtttgatgctgaagaaaaccgaagccgacatcagaatgagtattccccaaaaaatgctggaagacttggcggtcagtcaagcaggcaatattttcagcgtcaatgccgaagatgaggcggaaggcagggcaagtcttgacgacatcaacgagaccttgcgcctgatggtggacagtacggttcagagtatggcaagggaaaaatatctgactttgaacggcgaccagattgatactgccatttctctgaaaaacaatcagttgaaattgaacggtaaaacgttgcaaaacgaaccggagccggattttgatgaaggcggtatggtttcagagccgcagcagtaa

SEQ ID NO: 1836 - protein, 462 aa, Neisseria meningitidis
  misc_feature (111)..(111): Xaa can be any naturally occurring amino acid
  misc_feature (116)..(116): Xaa can be any naturally occurring amino acid
WFTSMETTVIRLKPELLNNARKYLPDNLKTVLEQPVTLVNHITHGPFAGGFGTQAYIETEFKYAPETEKVLERFFGKQVPASLANTVYFNGSGKMEVSVPAFDYEELSGIXLHWEXLTGETVYQKGFKSYRNGYDAPLFKIKLADKGDAAFEKVHFDSETSDGINPLALGSSNLTLEKFSLEWKEGVDYNVKLNELVNLVTDLQIGAFINPNGSIAPSKIEVGKLAFSTKTGESGAFINSEGQFRFDTLVYGDEKYGPLDIHIAAEHLDASALTVLKRKFAQISAKKMTEEQIRNDLIAAVKGEASGLFTNNPVLDIKTFRFTLPSGKIDVGGKIMFKDMKKEDLNQLGLMLKKTEADIRMSIPQKMLEDLAVSQAGNIFSVNAEDEAEGRASLDDINETLRLMVDSTVQSMAREKYLTLNGDQIDTAISLKNNQLKLNGKTLQNEPEPDFDEGGMVSEPQQ

SEQ ID NO: 1837 - DNA, 1551 bp, Neisseria meningitidis
atgaaaaaacctttgatttcggttgcggcagcattgctcggcgttgctttgggcacgccttattatttgggtgtcaaagccgaagaaagcttgacgcagcagcaaaaaatattgcaggaagcgggcttcttgaccgtcgaatcgcaccaatatgagcgcggctggtttacctctacggaaacgacggtcatccgcttgaaacccgagttgctgcataatgcgcagaaatacctgccggataacctgaaaacagtgttggaacagccggttacgctggtaaaccatatcacgcacggtccttttgccggcggattcggcacgcaggcgtacattgaaaccgagttcaaatacgcgcctgaaacggaaaaagttctggaacgcttttttggaaaacaagtcccggtttcccttgccaataccgtttattttaacggcagcggtaaaatggaagtcagtgttcccgccttcgattatgaagagctgtcgggcatcaggctgcactgggaaggcctgacgggagaaacggtttatcaaaaaggtttcaaaagctaccggaacggctatgatgcccccttgtttaaaatcaagctggcagacaaaggcgatgccgcgtttgaaaaagtgcatttcgattcggaaacttcagacggcatcaacccgcttgctttgggcagcagcaatctgaccttggaaaaattttccttagaatggaaagagggtgtcgattacaacgtcaagttaaacgaactggtcaatcttgttaccgatttgcagattggcgcgtttatcaatcccaacggcagcatcgcaccttccaaaatcgaagtcggcaagctggctttttcaaccaagaccggggaatcgggcgcgtttatcgatagcgaagggcagttccgttttggcacgctggtttacggcgatgaaaaatacggccctctggacatccatatcgctgccgaacacctcgatgcttctgccttaaccgtattgaaacgcaagtttgcacgaatttctgccaaaaaaatgactgaagaacaaatccgcaatgatttgattgcggcagtcaaaggcgaggcttccggattatttacccataacccagtattggacattaaaactttccgattcacgctgccatcgggaaaaatcgatgtgggcggaaaaatcatgtttaaagacatgaagaaggaagatttgaaccaattgggtttgatgctgaagaaaaccgaagccgacatcagaatgagtattccccaaaaaatgctggaagacttggcggtcagtcaagcaggcaatattttcagcgtcaatgccgaagatgaggcggaaggcagggcaagtcttgacgacatcaacgagaccttgcgcctgatggtggacagtacggttcagagtatggcaagggaaaaatatctgactttgaacggcgaccagattgatactgccatttctctgaaaaacaatcagttgaaattgaacggtaaaacgttgcaaaacgaaccggagccggattttgatgaaggcggtatggtttcagagccgcagcagtaa

SEQ ID NO: 1838 - protein, 516 aa, Neisseria meningitidis
MKKPLISVAAALLGVALGTPYYLGVKAEESLTQQQKILQEAGFLTVESHQYERGWFTSTETTVIRLKPELLHNAQKYLPDNLKTVLEQPVTLVNHITHGPFAGGFGTQAYIETEFKYAPETEKVLERFFGKQVPVSLANTVYFNGSGKMEVSVPAFDYEELSGIRLHWEGLTGETVYQKGFKSYRNGYDAPLFKIKLADKGDAAFEKVHFDSETSDGINPLALGSSNLTLEKFSLEWKEGVDYNVKLNELVNLVTDLQIGAFINPNGSIAPSKIEVGKLAFSTKTGESGAFIDSEGQFRFGTLVYGDEKYGPLDIHIAAEHLDASALTVLKRKFARISAKKMTEEQIRNDLIAAVKGEASGLFTHNPVLDIKTFRFTLPSGKIDVGGKIMFKDMKKEDLNQLGLMLKKTEADIRMSIPQKMLEDLAVSQAGNIFSVNAEDEAEGRASLDDINETLRLMVDSTVQSMAREKYLTLNGDQIDTAISLKNNQLKLNGKTLQNEPEPDFDEGGMVSEPQQ

SEQ ID NO: 1839 - DNA, 1551 bp, Neisseria meningitidis
atgaaaaaacctttgatttcggttgcggcagcattgctcggcgttgctttgggcacgccttattatttgggtgtcaaagccgaagaaagcttgacgcagcagcaaaaaatattgcaggaaacgggcttcttgaccgtcgaatcgcaccaatatgagcgcggctggtttacctctatggaaacgacggtcatccgtctgaaacccgagttgctgaataatgcccgaaaatacctgccggataacctgaaaacagtgttggaacagccggttacgctggttaaccatatcacgcacggccctttcgccggcggattcggcacgcaggcgtacattgaaaccgagttcaaatacgcgcctgaaacggaaaaagttctggaacgcttttttggaaaacaagtcccggcttcccttgccaataccgtttattttaacggcagcggtaaaatggaagtcagtgttcccgccttcgattatgaagagctgtcgggcatcaggctgcactgggaaggcctgacgggagaaacggtttatcaaaaaggtttcaaaagctaccggaacggctatgatgcccccttgtttaaaatcaagctggcagacaaaggcgatgccgcgtttgaaaaagtgcatttcgattcggaaacttcagacggcatcaatccgcttgctttgggcagcagcaatctgaccttggaaaaattctccctagaatggaaagagggtgtcgattacaacgtcaagttaaacgaactggtcaatcttgttaccgatttgcagattggcgcgtttatcaatcccaacggcagcatcgcaccttccaaaatcgaagtcggcaaactggctttttcaaccaagaccggggaatcaggcgcgtttatcaacagtgaagggcagttccgtttcgatacactggtgtacggcgatgaaaaatacggcccgctggacatccatatcgctgccgaacacctcgatgcttctgccttaaccgtattgaaacgcaagtttgcacaaatttccgccaaaaaaatgaccgaggaacaaatccgcaatgatttgattgccgccgtcaaaggagaggcttccggactgttcaccaacaatcccgtattggacattaaaactttccgattcacgctgccatcgggaaaaatcgatgtgggcggaaaaatcatgtttaaagacatgaagaaggaagatttgaatcaattgggtttgatgctgaagaaaaccgaagccgacatcagaatgagtattccccaaaaaatgctggaagacttggcggtcagtcaagcaggcaatattttcagcgtcaatgccgaagatgaggcggaaggcagggcaagtcttgacgacatcaacgagaccttgcgcctgatggtggacagtacggttcagagtatggcaagggaaaaatatctgactttgaacggcgaccagattgatactgccatttctctgaaaaacaatcagttgaaattgaacggtaaaacgttgcaaaacgaaccggagccggattttgatgaaggcggtatggtttcagagccgcagcagtaa

SEQ ID NO: 1840 - protein, 516 aa, Neisseria meningitidis
MKKPLISVAAALLGVALGTPYYLGVKAEESLTQQQKILQETGFLTVESHQYERGWFTSMETTVIRLKPELLNNARKYLPDNLKTVLEQPVTLVNHITHGPFAGGFGTQAYIETEFKYAPETEKVLERFFGKQVPASLANTVYFNGSGKMEVSVPAFDYEELSGIRLHWEGLTGETVYQKGFKSYRNGYDAPLFKIKLADKGDAAFEKVHFDSETSDGINPLALGSSNLTLEKFSLEWKEGVDYNVKLNELVNLVTDLQIGAFINPNGSIAPSKIEVGKLAFSTKTGESGAFINSEGQFRFDTLVYGDEKYGPLDIHIAAEHLDASALTVLKRKFAQISAKKMTEEQIRNDLIAAVKGEASGLFTNNPVLDIKTFRFTLPSGKIDVGGKIMFKDMKKEDLNQLGLMLKKTEADIRMSIPQKMLEDLAVSQAGNIFSVNAEDEAEGRASLDDINETLRLMVDSTVQSMAREKYLTLNGDQIDTAISLKNNQLKLNGKTLQNEPEPDFDEGGMVSEPQQ

SEQ ID NO: 1841 - DNA, 1341 bp, Neisseria gonorrhoeae
ttgcaaacccttctagcttttatcttcgccatcctgattttggtcagcctgcacgaattcggacactacatcgtcgccaggttgtgcggcgtcaaggttgtgcgtttttccgtcggcttcggcaaaccgtttttcacccgaaagcgcggcgacaccgaatggtgcctcgccccgattccgttgggcggctacgtcaaaatggtcgatacgcgcgaaggcgaagtatcagaagccgatttaccctacgcttttgacaaacaacaccccgccaagcgcatcgccatcgtcgccgccggtccgctgaccaacctcgcactggcggttttgctgtacggactgagcttttccttcggcgtaaccgaactgcggccctatgtcggcacagtcgaacccgacaccgttgccgcccgcaccggcttccaaagcggcgacaaaatacaatccgtcaacggcgtttccgtccaagactggagcagcgcgcaaaccgaaatcgtcctcaacctcgaagccggcaaagtcgccgtcggcgttcagacggcatcgggcgcgcaaaccgtccgcaccatcgatgccgcaggcacgccggaagccggtaaaatcgcaaaaaaccaaggctacatcggactgatgccctttaaaatcacaaccgttgccggcggcgtggaaaaaggcagccccgccgaaaaagcaggcctgaaaccgggcgacaggctgactgccgccgacggcaaacccatcgcctcatggcaggaatgggcaaacctgacccgccaaagcccgggcaaaaaaatcaccctgacctacgaacgcgccggacaaacccataccgccgacatccgccccgatactgtcgaacagcccgaccacaccctgatcgggcgcgtcggcctccgtccgcagccggacagggcgtgggacgcgcaaatccgccgcagctaccgtccgtctgttgtccgcgcattcggcatgggctgggaaaaaaccgtttcccactcgtggacaaccctcaaatttttcggcaaactaatcagcggcaacgcctctgtcagccatatttccgggccgctgaccattgccgacattgccggacagtccgccgaactcggcttgcaaagttatttggaatttttagcgttggtcagcatcagcctcggcgtgctgaacctgctgcccgtccccgttttggacggcgggcacctcgtgttttatactgtcgaatggatacgcggcaaacctttgggcgaacgtgtccaaaacatcggtttgcgcttcgggctcgccctgatgatgctgatgatggcggccgccttcttcaacgacgttacccggctgatcggttag

SEQ ID NO: 1842 - protein, 446 aa, Neisseria gonorrhoeae
LQTLLAFIFAILILVSLHEFGHYIVARLCGVKVVRFSVGFGKPFFTRKRGDTEWCLAPIPLGGYVKMVDTREGEVSEADLPYAFDKQHPAKRIAIVAAGPLTNLALAVLLYGLSFSFGVTELRPYVGTVEPDTVAARTGFQSGDKIQSVNGVSVQDWSSAQTEIVLNLEAGKVAVGVQTASGAQTVRTIDAAGTPEAGKIAKNQGYIGLMPFKITTVAGGVEKGSPAEKAGLKPGDRLTAADGKPIASWQEWANLTRQSPGKKITLTYERAGQTHTADIRPDTVEQPDHTLIGRVGLRPQPDRAWDAQIRRSYRPSVVRAFGMGWEKTVSHSWTTLKFFGKLISGNASVSHISGPLTIADIAGQSAELGLQSYLEFLALVSISLGVLNLLPVPVLDGGHLVFYTVEWIRGKPLGERVQNIGLRFGLALMMLMMAAAFFNDVTRLIG

SEQ ID NO: 1843 - DNA, 2682 bp, Neisseria meningitidis
ttgcacacccttctagcttttatcttcgccatcctgattttggtcagcctgcacgagttcggacactacatcgttgccagattgtgcggcgtcaaagtcgtacgcttttccgtcggcttcggcaaaccgtttttcacccgaaagcgcggcgacaccgaatggtgcctcgccccgattccgttgggcggttacgtcaaaatggtcgatacgcgcgaaggcgaagtatcagaagccgatttaccctacgcttttgacaaacaacaccccgccaagcgcatcgccatcgtcgccgccggcccactgaccaacctcgcactggcggttttgctgtacggactgagcttttccttcggcgtaaccgaactgcgcccctacgtcggcacagtcgaacccgacaccattgccgcccgcgccggcttccaaagcggcgacaaaatacaatccgtcaacggcacacccgttgcagattggggcagcgcgcaaaccgaaatcgtcctcaacctcgaagccggcaaagtcgccgtcggcgttcagacggcatcgggcgcgcaaaccgtccgcaccatcgatgccgcaggcacgccggaagccggtaaaatcgcaaaaaaccaaggctacatcggactgatgccctttaaaatcacaaccgttgccggcggcgtggaaaaaggcagccccgccgaaaaagcaggcctgaaaccgggcgacaggctgactgccgccgacggcaaacccatcgcctcatggcaagaatgggcaaacctgacccgccaaagccccggcaaaaaaatcaccctgaactacgaacgcgccggacaaacccataccgccgacatccgccccgatactgtcgaacagtccgaccacaccctgatcgggcgcgtcggcctccgtccgcagccggacagggcgtgggacgcgcaaatccgccgcagctaccgtccgtctgttgtccgcgcattcggcatgggctgggaaaaaaccgtttcccactcgtggacaaccctcaaatttttcggcaaactaatcagcggcaacgcctccgtcagccatatttccgggccgctgaccattgccgacattgccggacagtccgccgaactcggcttgcaaagttatttggaatttttagcactggtcagcatcagcctcggcgtgctgaacctactgcccgtccctgttttggacggcgggcacctcgtgttttatactgccgaatggatacgcggcaaacctttgggcgaacgcgtccaaaacatcggtttgcgcttcgggctcgccctcatgatgctgatgatggcggtcgccttcttcaacgacgttacccggctgctcggttagttgcacacccttctagcttttatcttcgccatcctgattttggtcagcctgcacgagttcggacactacatcgttgccagattgtgcggcgtcaaagtcgtacgcttttccgtcggcttcggcaaaccgtttttcacccgaaagcgcggcgacaccgaatggtgcctcgccccgattccgttgggcggttacgtcaaaatggtcgatacgcgcgaaggcgaagtatcagaagccgatttaccctacgcttttgacaaacaacaccccgccaagcgcatcgccatcgtcgccgccggcccactgaccaacctcgcactggcggttttgctgtacggactgagcttttccttcggcgtaaccgaactgcgcccctacgtcggcacagtcgaacccgacaccattgccgcccgcgccggcttccaaagcggcgacaaaatacaatccgtcaacggcacacccgttgcagattggggcagcgcgcaaaccgaaatcgtcctcaacctcgaagccggcaaagtcgccgtcggcgttcagacggcatcgggcgcgcaaaccgtccgcaccatcgatgccgcaggcacgccggaagccggtaaaatcgcaaaaaaccaaggctacatcggactgatgccctttaaaatcacaaccgttgccggcggcgtggaaaaaggcagccccgccgaaaaagcaggcctgaaaccgggcgacaggctgactgccgccgacggcaaacccatcgcctcatggcaagaatgggcaaacctgacccgccaaagccccggcaaaaaaatcaccctgaactacgaacgcgccggacaaacccataccgccgacatccgccccgatactgtcgaacagtccgaccacaccctgatcgggcgcgtcggcctccgtccgcagccggacagggcgtgggacgcgcaaatccgccgcagctaccgtccgtctgttgtccgcgcattcggcatgggctgggaaaaaaccgtttcccactcgtggacaaccctcaaatttttcggcaaactaatcagcggcaacgcctccgtcagccatatttccgggccgctgaccattgccgacattgccggacagtccgccgaactcggcttgcaaagttatttggaatttttagcactggtcagcatcagcctcggcgtgctgaacctactgcccgtccctgttttggacggcgggcacctcgtgttttatactgccgaatggatacgcggcaaacctttgggcgaacgcgtccaaaacatcggtttgcgcttcgggctcgccctcatgatgctgatgatggcggtcgccttcttcaacgacgttacccggctgctcggttag

SEQ ID NO: 1844 - protein, 446 aa, Neisseria meningitidis
LHTLLAFIFAILILVSLHEFGHYIVARLCGVKVVRFSVGFGKPFFTRKRGDTEWCLAPIPLGGYVKMVDTREGEVSEADLPYAFDKQHPAKRIAIVAAGPLTNLALAVLLYGLSFSFGVTELRPYVGTVEPDTIAARAGFQSGDKIQSVNGTPVADWGSAQTEIVLNLEAGKVAVGVQTASGAQTVRTIDAAGTPEAGKIAKNQGYIGLMPFKITTVAGGVEKGSPAEKAGLKPGDRLTAADGKPIASWQEWANLTRQSPGKKITLNYERAGQTHTADIRPDTVEQSDHTLIGRVGLRPQPDRAWDAQIRRSYRPSVVRAFGMGWEKTVSHSWTTLKFFGKLISGNASVSHISGPLTIADIAGQSAELGLQSYLEFLALVSISLGVLNLLPVPVLDGGHLVFYTAEWIRGKPLGERVQNIGLRFGLALMMLMMAVAFFNDVTRLLG

SEQ ID NO: 1845 - DNA, 1341 bp, Neisseria meningitidis
ttgcacacccttctagcttttatcttcgccatcctgattttggtcagcctgcacgaattcggacactacatcgtcgccagattgtgcggcgtcaaggttgtgcgtttttccgtcggcttcggcaaaccgtttttcacccgaaagcgcggcgacaccgaatggtgcctcgccccgattccgttgggcggttacgtcaaaatggtcgacacgcgcgaaggcgaagtatcagaagccgatttaccctacgcttttgacaaacaacaccccgccaagcgcatcgccatcgtcgccgccggcccgctgaccaacctcgcactggcggttttgctgtacggactgagcttttccttcggcgttaccgaactgcgcccctatgtcggcacagtcgaacccgacaccattgccgcccgcgccggcttccaaagcggcgacaaaatacaatccgtcaacggcacacccgttgcagattggggcagcgcgcaaaccgaaatcgtcctcaacctcgaagccggcaaagtcgccgtcggcgttcagacggcatcgggcgcgcaaaccgtccgcaccatcgatgccgcaggcacgccggaagccggtaaaatcgcaaaaaaccaaggctacatcggactgatgccctttaaaatcacaaccgttgccggcggcgtggaaaaaggcagccccgccgaaaaagcaggcctgaaaccgggcgacaggctgactgccgccgacggcaaacccatcgcctcatggcaagaatgggcaaacctgacccgccaaagccccggcaaaaaaatcaccctgacctacgaacgcgccggacaaacccataccgccgacatccgccccgatactgtcgaacagcccgaccacaccctgatcgggcgcgtcggcctccgtccgcagccggacagggcgtgggacgcgcaaatccgccgcagctaccgtccgtctgttgtccgcgcattcggcatgggctgggaaaaaaccgtttcccactcgtggacaaccctcaaatttttcggcaaactaatcagcggcaacgcctccgtcagccatatttccggtccgctgaccattgccgatattgccggacagtccgccgaactcggcttgcaaagttatttggaatttttggcactggtcagcatcagcctcggcgtgctgaacctgctgcccgtccccgttttggacggcggccacctcgtgttttatactgccgaatggatacgcggcaaacctttgggcgaacgcgtccaaaacatcggtttgcgcttcgggcttgccctcatgatgctgatgatggcggtcgccttcttcaacgacgttacccggctgctcggttag

SEQ ID NO: 1846 - protein, 446 aa, Neisseria meningitidis
LHTLLAFIFAILILVSLHEFGHYIVARLCGVKVVRFSVGFGKPFFTRKRGDTEWCLAPIPLGGYVKMVDTREGEVSEADLPYAFDKQHPAKRIAIVAAGPLTNLALAVLLYGLSFSFGVTELRPYVGTVEPDTIAARAGFQSGDKIQSVNGTPVADWGSAQTEIVLNLEAGKVAVGVQTASGAQTVRTIDAAGTPEAGKIAKNQGYIGLMPFKITTVAGGVEKGSPAEKAGLKPGDRLTAADGKPIASWQEWANLTRQSPGKKITLTYERAGQTHTADIRPDTVEQPDHTLIGRVGLRPQPDRAWDAQIRRSYRPSVVRAFGMGWEKTVSHSWTTLKFFGKLISGNASVSHISGPLTIADIAGQSAELGLQSYLEFLALVSISLGVLNLLPVPVLDGGHLVFYTAEWIRGKPLGERVQNIGLRFGLALMMLMMAVAFFNDVTRLLG

SEQ ID NO: 1847 - DNA, 714 bp, Neisseria gonorrhoeae
atgattccggacgtgttcggtcagattttttcgggcgcgttcaaattcgacgcggcagcaggcggcttactcggcggtctgatttcgcaaacgatgatgatgggcatcaaacgcggcctgtattccaacgaggcgggtatgggttccgcgccgaacgccgccgccgccgccgaagtgaaacaccctgtttcgcaaggtatgattcaaatgctgggcgtgtttgtcgataccatcatcgtttgttcttgcaccgccttcatcatcttgatttaccaacagccttatggcgatttgagcggtgcggcgctgacgcaggcggcgattgtcagccaagtggggcaatggggcgcgggtttcctcgccgtcatcctgtttatgtttgccttttccaccgttatcggcaactatgcctatgccgagtccaacgtccaattcatcaaaagccattggctgattaccgccgttttccgtatgctggttttggcgtgggtctatttcggcgcggttgccaatgtgcctttggtctgggatatggcggatatggcgatgggcatcatggcgtggatcaacctcgtcgccatcctgctgctctcgccattggcgtttatgctgctgcgcgattacaccgccaagctgaaaatgggcaaagaccccgagttcaaactttccgaacatccgggcctgaaacgccgcatcaaatccgatgtttggtaa

SEQ ID NO: 1848 - protein, 237 aa, Neisseria gonorrhoeae
MIPDVFGQIFSGAFKFDAAAGGLLGGLISQTMMMGIKRGLYSNEAGMGSAPNAAAAAEVKHPVSQGMIQMLGVFVDTIIVCSCTAFIILIYQQPYGDLSGAALTQAAIVSQVGQWGAGFLAVILFMFAFSTVIGNYAYAESNVQFIKSHWLITAVFRMLVLAWVYFGAVANVPLVWDMADMAMGIMAWINLVAILLLSPLAFMLLRDYTAKLKMGKDPEFKLSEHPGLKRRIKSDVW

SEQ ID NO: 1849 - DNA, 714 bp, Neisseria meningitidis
atgattccggacgtgttcggtcagattttttcgggcgcgttcaaattcgacgcggcagcaggcggcttactcggcggtctgatttcgcaaacgatgatgatgggcatcaaacgcggcctgtattccaacgaggcgggtatgggttccgcgccgaacgccgccgccgccgccgaagtgaaacaccctgtttcgcaaggtatgattcaaatgctgggcgtgtttgtcgataccatcatcgtttgttcttgcaccgccttcatcatcttgatttaccaacagccttacggcgatttgagcggtgcggcgctgacgcaggcggcgattgtcagccaagtggggcaatggggcgcgggcttcctcgccgtcatcctgtttatgtttgccttttccaccgttatcggcaactatgcctatgccgagtccaacgtccaattcatcaaaagccattggctgattaccgccgttttccgtatgctggttttggcgtgggtctatttcggcgcggttgccaatgtgcctttggtctgggatatggcggatatggcgatgggcattatggcgtggatcaaccttgtcgccatcctgctgctctcgcccttggcgtttatgctgctgcgcgattacaccgccaagctgaaaatgggcaaagaccccgagttcaaactttccgaacatccgggcctgaaacgccgtatcaaatccgacgtttggtaa

SEQ ID NO: 1850 - protein, 237 aa, Neisseria meningitidis; identical to SEQ ID NO: 1848

SEQ ID NO: 1851 - DNA, 714 bp, Neisseria meningitidis; identical to SEQ ID NO: 1849

SEQ ID NO: 1852 - protein, 237 aa, Neisseria meningitidis; identical to SEQ ID NO: 1848

SEQ ID NO: 1853 - DNA, 942 bp, Neisseria gonorrhoeae
atgcttgaactgaacggactctgcaaatgcttcggcggcaaaacggtcgccgacaacatctgcctgactgtcgggcgcggcaaaatactcgccgtactggggcggtcgggctgcggcaaatccaccctgctgaatatgattgcgggcatcgtccggccggacggcggcgaaattcggctgaacggggaaaacattacctgtatgccgcccgaaaaacgccgtatctcgctgatgtttcaagattacgcgctgtttccccatatgagtgcgctggaaaatacggcattcggtttgaaaatgcaaaaaatgccgaaagccgaagccgaacgcctcgccttgtcggcacttgccgaagtcgggctggaaaacgaggcgcaccgcaagcctgaaaaactttccggaggcgagaagcaacggttggcactggcgcgcgctttggttgtccgcccttccctgctgttgctggatgaatcgttttccagtttggacacgcatttgcgcgaccggctgcgccgtatgaccgccgaacgcatccgcaagggcggcatccctgccgttttggtaacgcattcgcccgaagaggcctgcacggcggcggacgaaatcgccgtcatgcacgaggggaaaatccttcaatgcggtacgcccgaaaccttgattcaaacgcctgccggcgtgcaggtcgcccgtctgatggggctgcccaataccgacgatgaccgccatattccgcaaaatgccgtgtgcttggacaatcatggaacggaatgccgtctgctgtccctcgtccgcctgcccgactcgctccggctttccgccgtccatcccgaacacggcgagctgaccttaaacctgactgtcggacaacatacggacggtatttccggaaacggtacggtccgcatccgcgtcgatgaagggcgtatcgtccgtttccgatga

SEQ ID NO: 1854 - protein, 313 aa, Neisseria gonorrhoeae
MLELNGLCKCFGGKTVADNICLTVGRGKILAVLGRSGCGKSTLLNMIAGIVRPDGGEIRLNGENITCMPPEKRRISLMFQDYALFPHMSALENTAFGLKMQKMPKAEAERLALSALAEVGLENEAHRKPEKLSGGEKQRLALARALVVRPSLLLLDESFSSLDTHLRDRLRRMTAERIRKGGIPAVLVTHSPEEACTAADEIAVMHEGKILQCGTPETLIQTPAGVQVARLMGLPNTDDDRHIPQNAVCLDNHGTECRLLSLVRLPDSLRLSAVHPEHGELTLNLTVGQHTDGISGNGTVRIRVDEGRIVRFR

SEQ ID NO: 1855 - DNA, 939 bp, Neisseria meningitidis
atgcttgaactgaacggactctgcaaacgcttcggcaataaaaccgtcgccgacaacatctgcctgactgtcgggcgcggcaaaatactcgccgttttggggcggtcgggctgcggaaaatccaccctgctgaatataattgcggggattgtccggccggacggcggggaaatatggctgaacggagaaaacattacccgtatgccgcccgaaaaacgccgtatctcgctgatgtttcaagattacgcgctgtttccccatatgagtgcgctggaaaatgcggcattcggtttgaaaatgcaaaaaatgccgaaagccgaagccgaacgcctcgccatggcggcacttgccgaagtcggactggaaaacgaggcgcaccgcaagcctgaaaaactttccggaggcgagaagcaacggctggcgttggcgcgcgctttggttgtccgcccttccctgctgctgttggacgaatcgttttccagtttggacacgcatttgcgcggcacgctgcgccgtatgactgccgaacgtatccgaaacggcggcatccctgccgttttggtaacgcattcgcccgaagaagcctgtacgacggcagacgaaatcgccgtgatgcataaagggaggattctacaatacggtacgcccgaaacattggtcaaaacaccatcctgcgtgcaggtcgcccgactgatgggtttgcccaataccgacgataaccgccatattccgcaacatgcggtgcgtttcgaccaagacggcatggagtgccgcgtattatcccgtacctgtttgcccgaatcgttcagcctgtccgtcctccatccggaacacggcatcctgtggctgaacctcgatatgcggcacgccggggcggtatcgggcaaggatacggtacgcatccatatcgaagaacgggaaatcgtccgcttccgctga

SEQ ID NO: 1856 - protein, 312 aa, Neisseria meningitidis
MLELNGLCKRFGNKTVADNICLTVGRGKILAVLGRSGCGKSTLLNIIAGIVRPDGGEIWLNGENITRMPPEKRRISLMFQDYALFPHMSALENAAFGLKMQKMPKAEAERLAMAALAEVGLENEAHRKPEKLSGGEKQRLALARALVVRPSLLLLDESFSSLDTHLRGTLRRMTAERIRNGGIPAVLVTHSPEEACTTADEIAVMHKGRILQYGTPETLVKTPSCVQVARLMGLPNTDDNRHIPQHAVRFDQDGMECRVLSRTCLPESFSLSVLHPEHGILWLNLDMRHAGAVSGKDTVRIHIEEREIVRFR

SEQ ID NO: 1857 - DNA, 939 bp, Neisseria meningitidis
  misc_feature (390)..(390): n is a, c, g, or t
atgcttgaactgaacggactctgcaaacgcttcggcggcaaaacggttgccgacgatatctgcctgactgtcgggcgcggcaaaatactcgccgttttggggcggtcgggctgcggcaaatccaccctgctgaatatgattgcgggcatcgtccggccggacggcggggaaatatggctgaatggggaaaacattacccgtatgccgcccgaaaaacgccgtatttcgctgatgtttcaagattacgcgctgtttccccatatgagtgcactggaaaatgcggcattcggtttgaaaatgcaaaaaatgccgaaagccgaagccgaaagcctcgccatggcggcacttgccgaagtcggactggaaaacgaggcgcaccgcaagcctganaaactttccggaggcgaaaagcaacggttggcactggcgcgcgctttggttgtccgcccttccctgctgctgttggacgaatcgttttccagtttggacacgcatttgcgcgaccggctgcgccgcatgactgccgaacgtatccgcaagggcggcatccctgccgttttggtaacgcattcgcccgaagaggcctgcacggcggcagacgaaatcgccgtcatgcacgaggggaaaatccttcaatgcggtacgcccgaaaccttggttcaaacgcctgccggcgtgcaggtcgcccatctgatggggctgcccaataccgacgatgaccgccatattccgcaacatgcggtgcgtttcgaccaagacggcatggagtgccgcgtattatcccgtacctgtttgcccgaatcgttcagcctgtccgtcctccatccggaacacggcatcctgtggctgaacctcgatatgccgcacgccggtgaaatatcgggaaacgatacggtacgcatccatatcgaagacagggaaatcgtccgcttccgctga

SEQ ID NO: 1858 - protein, 312 aa, Neisseria meningitidis
  misc_feature (130)..(130): Xaa can be any naturally occurring amino acid
MLELNGLCKRFGGKTVADDICLTVGRGKILAVLGRSGCGKSTLLNMIAGIVRPDGGEIWLNGENITRMPPEKRRISLMFQDYALFPHMSALENAAFGLKMQKMPKAEAESLAMAALAEVGLENEAHRKPXKLSGGEKQRLALARALVVRPSLLLLDESFSSLDTHLRDRLRRMTAERIRKGGIPAVLVTHSPEEACTAADEIAVMHEGKILQCGTPETLVQTPAGVQVAHLMGLPNTDDDRHIPQHAVRFDQDGMECRVLSRTCLPESFSLSVLHPEHGILWLNLDMPHAGEISGNDTVRIHIEDREIVRFR

SEQ ID NO: 1859 - DNA, 477 bp, Neisseria gonorrhoeae
atgggtgcagataccgatggcgacaaggatgttcggcttaatcgaacgggtctcgtttttagcatactccggctgctgttccgcatcggaattgggatcggtaagttcgccgttcaggcctttcaggtctttaagctgctgatctgtacggttgagcacccaaatcggtttgccttgccactcggcggtcagcagctgacccgcttcgattttactgacatccacctcgacggcagcaccggaggccttggctttttccgaagggaaaaaactggccacaaacggcgttgccacacccaatgctgccactccgcccgcgccgcaggtcgcaagtgtcaggaaacggcggcggccgttgttgatttcttgattatccattattcagtcgtcctaatattttgggaatgccgagccattaaacattgcaattttacccagtttgcagtgatactcaaagcattatttaaaataaggtaa

SEQ ID NO: 1860 - protein, 158 aa, Neisseria gonorrhoeae
MGADTDGDKDVRLNRTGLVFSILRLLFRIGIGIGKFAVQAFQVFKLLICTVEHPNRFALPLGGQQLTRFDFTDIHLDGSTGGLGFFRREKTGHKRRCHTQCCHSARAAGRKCQETAAAVVDFLIIHYSVVLIFWECRAIKHCNFTQFAVILKALFKIR

SEQ ID NO: 1861 - DNA, 477 bp, Neisseria meningitidis
atgggtgcagataccgatggcgacaaggatgttcggcttaatcgaacgggtctcgtttttagcatactccggctgctgttccgcatcggaattgggatcggtaagttcgccgttcaggcctttcaggtctttaagctgctgatctgtacggttgagcacccaaatcggtttgccttgccactcggcggtcagcagctgacccgcttcgattttactgacatccacctcgacggcagcaccggcggccttggctttttccgaagggaaaaaactggccacaaacggcgttgccacacccaatgctgccactccgcccgcgccgcaggtcgcgagtgtcaggaaacggcggcggccgttgttgatttcttgattatccattattcagtcgtcctaatattttgggaataccgagccattaaacgttgcaattttacccagtttgcagtgatactcaaagcattatttaaaataaggtaa

SEQ ID NO: 1862 - protein, 158 aa, Neisseria meningitidis
MGADTDGDKDVRLNRTGLVFSILRLLFRIGIGIGKFAVQAFQVFKLLICTVEHPNRFALPLGGQQLTRFDFTDIHLDGSTGGLGFFRREKTGHKRRCHTQCCHSARAAGRECQETAAAVVDFLIIHYSVVLIFWEYRAIKRCNFTQFAVILKALFKIR

SEQ ID NO: 1863 - DNA, 477 bp, Neisseria meningitidis
atgggtgcagataccgatggcgacaaggatgttcggcttaatcgaacgggtctcgtttttagcatactccggctgctgttccgcatcggaattgggatcggtaagttcgccgttcaggcctttcaggtctttaagctgctgatctgtacggttgagcacccaaatcggtttgccttgccactcggcggtcagcaactgacccgcttcgattttactgacatccacctcgacggcagcaccggcggccttggctttttccgaagggaaaaaactggccacaaacggcgttgccacacccaatgctgccactccgcccgcgccgcaggtcgcgagtgtcaggaaacggcggcggccgttgttgatttcttgattatccattattcagtcgtcctaatattttgggaataccgagccattaaacgttgcaattttacccagtttgcagtgatactcaaagcattatttaaaataaggtaa

SEQ ID NO: 1864 - protein, 158 aa, Neisseria meningitidis; identical to SEQ ID NO: 1862

SEQ ID NO: 1865 - DNA, 1167 bp, Neisseria gonorrhoeae
atgagaaaattcaatttgaccgcattgtccgtgatgcttgccttgggtttgaccgcgtgccagccgccggaggcggagaaagccgcgccggccgcgtccggtgagacccaatccgccaacgaaggcggttcggtcggtatcgccgtcaacgacaatgcctgcgaaccgatgaatctgaccgtgccgagcggacaggttgtgttcaatattaaaaacaacagcggccgcaagctcgaatgggaaatcctgaagggcgtgatggtggtggacgaacgcgaaaatatcgccccggggctttccgacaaaatgaaccgtaacctgctgccgggcgaatacgaaatgacctgcggccttttgaccaatccgcgcggcaagctggtggtagccgacagcggctttaaagacaccgccaacgaagcggatttggaaaaactgccccaaccgctcgccgactataaagcctacgttcaaggcgaggttaaagagctggcggcgaaaaccaaaacctttaccgaagccgtcaaagcaggcgacattgaaaaggcgaaatccctgtttgccgccacccgcgtccattacgaacgcatcgaaccgattgccgagcttttcagcgaactcgaccccgtcatcgatgcgtgtgaagacgacttcaaagacggtgcgaaagatgccgggtttaccggcttccaccgtatcgaacacgccctttgggtggaaaaagacgtatccggcgtgaaggaaaccgcggccaaactgatgaccgatgtcgaagccctgcaaaaagaaatcgacgcattggcgttccctccgggcaaagtggtcggcggcgcgtccgaactgattgaagaagcggcgggcagtaaaatcagcggcgaagaagaccgttacagccacaccgatttgagcgacttccaagctaatgcggacggatctaaaaaaatcgtcgatttgttccgtccgttgattgaggccaaaaacaaagccttgttggaaaaaaccgataccaacttcaaacaggtcaacgaaattctggcgaaataccgcaccaaagacggttttgaaacctacgacaagctgagcgaagccgaccgcaaagcattacaggctcctattaacgcgcttgccgaagaccttgcccaacttcgcggcatactcggcttgaaataa

SEQ ID NO: 1866 - protein, 388 aa, Neisseria gonorrhoeae
MRKFNLTALSVMLALGLTACQPPEAEKAAPAASGETQSANEGGSVGIAVNDNACEPMNLTVPSGQVVFNIKNNSGRKLEWEILKGVMVVDERENIAPGLSDKMNRNLLPGEYEMTCGLLTNPRGKLVVADSGFKDTANEADLEKLPQPLADYKAYVQGEVKELAAKTKTFTEAVKAGDIEKAKSLFAATRVHYERIEPIAELFSELDPVIDACEDDFKDGAKDAGFTGFHRIEHALWVEKDVSGVKETAAKLMTDVEALQKEIDALAFPPGKVVGGASELIEEAAGSKISGEEDRYSHTDLSDFQANADGSKKIVDLFRPLIEAKNKALLEKTDTNFKQVNEILAKYRTKDGFETYDKLSEADRKALQAPINALAEDLAQLRGILGLK

SEQ ID NO: 1867 - DNA, 1167 bp, Neisseria meningitidis
atgagaaaattcaatttgaccgcattgtccgtgatgcttgccttaggtttgaccgcgtgccagccgccggaggcggagaaagctgcgccggcagcgtccggtgaggcgcaaaccgccaacgagggcggttcggtcagtatcgccgtcaacgacaatgcctgcgaaccgatggaactgaccgtgccgagcggacaggttgtgttcaatattaaaaacaacagcggccgcaagctcgaatgggaaatcctgaaaggcgtgatggtggtggacgagcgcgaaaacatcgcccccggactttccgataaaatgaccgtcaccctgttgccgggcgaatacgaaatgacttgcggtcttttgaccaatccgcgcggcaagctggtggtaaccgacagcggctttaaagacaccgccaacgaagcggatttggaaaaactgtcccaaccgctcgccgactataaagcctacgttcaaggcgaggttaaagagctggtggcgaaaaccaaaacttttaccgaagccgtcaaagcaggcgacattgaaaaggcgaaatccctgtttgccgacacccgcgtccattacgaacgcatcgaaccgattgccgagcttttcagcgaactcgaccccgtcatcgatgcgcgtgaagacgacttcaaagacggcgcgaaagatgccggatttaccggctttcaccgtatcgaatacgccctttgggtggaaaaagacgtgtccggcgtgaaggaaattgcagcgaaactgatgaccgatgtcgaagccctgcaaaaagaaatcgacgcattggcgtttcctccgggcaaggtggtcggcggcgcgtccgaactgattgaagaagtggcgggcagtaaaatcagcggcgaagaagaccggtacagccacaccgatttgagcgacttccaagccaatgtggacggatctaaaaaaatcgtcgatttgttccgtccgctgatcgaggccaaaaacaaagccttgttggaaaaaaccgataccaacttcaaacaggtcaacgaaattctggcgaaataccggactaaagacggttttgaaacctacgacaagctgggcgaagccgaccgcaaagcgttacaggcctctattaacgcgcttgccgaagaccttgcccaacttcgcggcatactcggcttgaaataa

SEQ ID NO: 1868 - protein, 388 aa, Neisseria meningitidis
MRKFNLTALSVMLALGLTACQPPEAEKAAPAASGEAQTANEGGSVSIAVNDNACEPMELTVPSGQVVFNIKNNSGRKLEWEILKGVMVVDERENIAPGLSDKMTVTLLPGEYEMTCGLLTNPRGKLVVTDSGFKDTANEADLEKLSQPLADYKAYVQGEVKELVAKTKTFTEAVKAGDIEKAKSLFADTRVHYERIEPIAELFSELDPVIDAREDDFKDGAKDAGFTGFHRIEYALWVEKDVSGVKEIAAKLMTDVEALQKEIDALAFPPGKVVGGASELIEEVAGSKISGEEDRYSHTDLSDFQANVDGSKKIVDLFRPLIEAKNKALLEKTDTNFKQVNEILAKYRTKDGFETYDKLGEADRKALQASINALAEDLAQLRGILGLK

SEQ ID NO: 1869 - DNA, 1167 bp, Neisseria meningitidis
atgagaaaattcaatttgaccgcattgtccgtgatgcttgccttaggtttgaccgcgtgccagccgccggaggcggagaaagctgcgccggcagcgtccggtgaggcgcaaaccgccaacgagggcggttcggtcagtatcgccgtcaacgacaatgcctgcgaaccgatggaactgaccgtgccgagcggacaggttgtgttcaatattaaaaacaacagcggccgcaagctcgaatgggaaatcctgaaaggcgtgatggtggtggacgagcgcgaaaacatcgcccccggactttccgataaaatgaccgtcaccctgttgccgggcgaatacgaaatgacttgcggtcttttgaccaatccgcgcggcaagctggtggtaaccgacagcggctttaaagacaccgccaacgaagcggatttggaaaaactgtcccaaccgctcgccgactataaagcctatgttcaaggcgaagtcaaagagctggtggcgaaaaccaaaacctttaccgaagccgtcaaagcaggcgacattgaaaaggcgaaatccctgtttgccgacacccgcgtccattacgaacgcatcgaaccgattgccgagcttttcagcgaactcgaccccgtcatcgatgcgcgtgaagacgacttcaaagacggcgcgaaagatgccggatttaccggcttccaccgtatcgaatacgccctttgggtggaaaaagacgtgtccggcgtgaaggaaattgcagcgaaactgatgaccgatgtcgaagccctgcaaaaagaaatcgacgcattggcgtttcctccgggcaaggtggtcggcggcgcgtccgaactgattgaagaagtggcgggcagtaaaatcagcggcgaagaagaccggtacagccacaccgatttgagcgacttccaagccaatgtggacggatcgaaaaaaatcgtcgatttgttccgtccgttgatcgagaccaaaaacaaagccttgttggaaaaaaccgataccaacttcaaacaggtcaacgaaattctggcgaaataccggactaaagacggttttgaaacctacgacaagctgggcgaagccgaccgcaaagcgttacaggcctctattaacgcgcttgccgaagaccttgcccaacttcgcggcatactcggcttgaaataa

SEQ ID NO: 1870 - protein, 388 aa, Neisseria meningitidis
MRKFNLTALSVMLALGLTACQPPEAEKAAPAASGEAQTANEGGSVSIAVNDNACEPMELTVPSGQVVFNIKNNSGRKLEWEILKGVMVVDERENIAPGLSDKMTVTLLPGEYEMTCGLLTNPRGKLVVTDSGFKDTANEADLEKLSQPLADYKAYVQGEVKELVAKTKTFTEAVKAGDIEKAKSLFADTRVHYERIEPIAELFSELDPVIDAREDDFKDGAKDAGFTGFHRIEYALWVEKDVSGVKEIAAKLMTDVEALQKEIDALAFPPGKVVGGASELIEEVAGSKISGEEDRYSHTDLSDFQANVDGSKKIVDLFRPLIETKNKALLEKTDTNFKQVNEILAKYRTKDGFETYDKLGEADRKALQASINALAEDLAQLRGILGLK

SEQ ID NO: 1871 - DNA, 1122 bp, Neisseria gonorrhoeae
atgctgctcttggacgagccgaccaaccacttggatgcggaatcggtggaatggctggagcaattcctcgtgcgcttccccggcacagtggtcgcggtaacgcacgaccgctacttcctcgacaacgccgccgaatggattttggaactcgaccgcggacacggcattccgtggaaaggcaattactcgtcttggctggagcagaaagaaaaacgcttggaaaacgaggcgaaatccgaagccgcgcgcgtgaaggcgatgaagcaggaattggaatgggtgcgccaaaatgccaaaggccgccaagccaagcccaaagcgcgtttggcgcgttttgaagaaatgagcaactacgaataccaaaaacgcaacgaaactcaggaaatctttatccctgttgccgagcgtttgggtaacgaagtgattgaatttgtgaatgtttccaaatcgttcggcgataaagtgctgattgacggtttgagcttcaaagtgccggcgggcgcgattgtcggcatcatcggcccgaacggcgcgggtaaatcgacgctgttcaaaatgattgcgggcaaagagcagcccgattcgggcgaagtgaaaatcgggcaaaccgtgaaaatgagcttgattgaccaaagccgcgaaggtttgcaaaacgacaaaaccgtgttcgacaacattgccgaaggtcgcgatattttgcaggtcggacagtttgaaatccccgcccgccaatatttgggacgcttcaactttaaaggcagcgaccaaagcaaaatcgcaaggcagctttccggcggcgaacgcggccgtctgcacttggcaaaaaccttgttgggcggcggcaatgtgttgctgctggacgaaccgtccaacgatctcgacgtggaaaccctgcgcgcgttggaagacgcattgttggaatttgccggcagcgtgatggtgatttcgcacgaccgctggtttctcgaccgcatagccacgcatatcttggcgtgtgaaggcgactccaaatgggtgttcttcgacggcaactatcaagaatacgaagccgacaagaaacgccgactcggcaaagaaggcgcgaaaccgaaacgcatcaaatacaaaccggtaacgcgttaa

SEQ ID NO: 1872 - protein, 373 aa, Neisseria gonorrhoeae
MLLLDEPTNHLDAESVEWLEQFLVRFPGTVVAVTHDRYFLDNAAEWILELDRGHGIPWKGNYSSWLEQKEKRLENEAKSEAARVKAMKQELEWVRQNAKGRQAKPKARLARFEEMSNYEYQKRNETQEIFIPVAERLGNEVIEFVNVSKSFGDKVLIDGLSFKVPAGAIVGIIGPNGAGKSTLFKMIAGKEQPDSGEVKIGQTVKMSLIDQSREGLQNDKTVFDNIAEGRDILQVGQFEIPARQYLGRFNFKGSDQSKIARQLSGGERGRLHLAKTLLGGGNVLLLDEPSNDLDVETLRALEDALLEFAGSVMVISHDRWFLDRIATHILACEGDSKWVFFDGNYQEYEADKKRRLGKEGAKPKRIKYKPVTR

SEQ ID NO: 1873 - DNA, 3354 bp, Neisseria meningitidis
atgtcccaacaatacgtctattctatgctgcgcgtgagcaaggttgtgccgccgcagaaaaccatcattaaagatatttccctttctttcttccccggcgcgaaaatcggcctgctcggtttgaacggcgcgggcaagtccaccgtgctgcggattatggcgggcgtggataaggaatttgagggcgaagccgtgccgatgggcggcatcaaaatcggctacctgccgcaagagcctgagcttgatccggaaaaaaccgtgcgcgaggaagtggaaagcggtttgggcgaagtggctgccgcgcagaaacgtttggaagaagtgtatgccgagtacgccaatcctgatgcggattttgacgcgttggcagaagagcagggccgcttggaagcgattattgcggcaggttcgtccacgggcggcggtgcggaacacgaattggaaatcgccgccgacgcgctgcgcctgccggaatgggatgccaaaatcgataatttgtccggcggtgaaaaacgccgcgttgccttgtgcaaactcttgttgagcaagcccgatatgcttttgctggacgagccgaccaaccacttggatgcggaatcggtcgagtggctggagcaatttctcgtgcgcttccccggcacagtcgttgcggtaacgcacgaccgctacttcctcgacaacgccgccgaatggattttggaactcgaccgcggccatggtattccgtggaaaggcaattactcgtcttggctggagcagaaagaaaaacgcttggaaaacgaggcaaaatccgaagccgcgcgcgtgaaggcgatgaagcaggaattggaatgggtgcgccaaaatgccaaaggccgccaagccaagtccaaagcgcgtttggctcgttttgaagaaatgagcaactacgaataccaaaaacgcaatgaaacgcaggaaatctttattcccgttgccgagcgtttgggtaacgaagtgattgaatttgtaaatgtttccaaatcgttcggcgataaagtgctgattgacgatttgagcttcaaagtgcctgcgggcgcgattgtcggcatcatcggcccgaacggcgcgggtaaatctacgctgttcaaaatgatttcgggcaaagagcagcctgattccggcgaggtgaaaatcggacaaaccgtgaaaatgagcttgattgaccaaagccgcgaaggtttgcaaaacgacaaaaccgtgttcgacaacattgccgaaggccgcgacattttgcaggttggtcagtttgaaattcccgcccgccaatatttggggcgtttcaacttcaaaggcagcgaccaaagcaaaattgcaggtcaattgtctggcggcgaacgcggtcgtctgcacttggcaaaaaccttgttgagcggcggcaatgtattgctgctggatgaaccgtctaacgaccttgacgtggaaaccctgcgcgcgttggaagacgcattgttggaatttgccggcagcgtgatggtgatttcgcacgaccgttggttcctcgaccgcatcgccacgcatatcttggcgtgtgaaggcgactctaaatgggtgttcttcgacggcaactatcaggaatacgaagccgacaagaaacgccgtttgggcgaagaaggcgcgaaaccgaaacgcatcaaatacaaaccggtaacgcgttaaatgtcccaacaatacgtctattctatgctgcgcgtgagcaaggttgtgccgccgcagaaaaccatcattaaagatatttccctttctttcttccccggcgcgaaaatcggcctgctcggtttgaacggcgcgggcaagtccaccgtgctgcggattatggcgggcgtggataaggaatttgagggcgaagccgtgccgatgggcggcatcaaaatcggctacctgccgcaagagcctgagcttgatccggaaaaaaccgtgcgcgaggaagtggaaagcggtttgggcgaagtggctgccgcgcagaaacgtttggaagaagtgtatgccgagtacgccaatcctgatgcggattttgacgcgttggcagaagagcagggccgcttggaagcgattattgcggcaggttcgtccacgggcggcggtgcggaacacgaattggaaatcgccgccgacgcgctgcgcctgccggaatgggatgccaaaatcgataatttgtccggcggtgaaaaacgccgcgttgccttgtgcaaactcttgttgagcaagcccgatatgcttttgctggacgagccgaccaaccacttggatgcggaatcggtcgagtggctggagcaatttctcgtgcgcttccccggcacagtcgttgcggtaacgcacgaccgctacttcctcgacaacgccgccgaatggattttggaactcgaccgcggccatggtattccgtggaaaggcaattactcgtcttggctggagcagaaagaaaaacgcttggaaaacgaggcaaaatccgaagccgcgcgcgtgaaggcgatgaagcaggaattggaatgggtgcgccaaaatgccaaaggccgccaagccaagtccaaagcgcgtttggctcgttttgaagaaatgagcaactacgaataccaaaaacgcaatgaaacgcaggaaatctttattcccgttgccgagcgtttgggtaacgaagtgattgaatttgtaaatgtttccaaatcgttcggcgataaagtgctgattgacgatttgagcttcaaagtgcctgcgggcgcgattgtcggcatcatcggcccgaacggcgcgggtaaatctacgctgttcaaaatgatttcgggcaaagagcagcctgattccggcgaggtgaaaatcggacaaaccgtgaaaatgagcttgattgaccaaagccgcgaaggtttgcaaaacgacaaaaccgtgttcgacaacattgccgaaggccgcgacattttgcaggttggtcagtttgaaattcccgcccgccaatatttggggcgtttcaacttcaaaggcagcgaccaaagcaaaattgcaggtcaattgtctggcggcgaacgcggtcgtctgcacttggcaaaaaccttgttgagcggcggcaatgtattgctgctggatgaaccgtctaacgaccttgacgtggaaaccctgcgcgcgttggaagacgcattgttggaatttgccggcagcgtgatggtgatttcgcacgaccgttggttcctcgaccgcatcgccacgcatatcttggcgtgtgaaggcgactctaaatgggtgttcttcgacggcaactatcaggaatacgaagccgacaagaaacgccgtttgggcgaagaaggcgcgaaaccgaaacgcatcaaatacaaaccggtaacgcgttaa

SEQ ID NO: 1874 - protein, 558 aa, Neisseria meningitidis
MSQQYVYSMLRVSKVVPPQKTIIKDISLSFFPGAKIGLLGLNGAGKSTVLRIMAGVDKEFEGEAVPMGGIKIGYLPQEPELDPEKTVREEVESGLGEVAAAQKRLEEVYAEYANPDADFDALAEEQGRLEAIIAAGSSTGGGAEHELEIAADALRLPEWDAKIDNLSGGEKRRVALCKLLLSKPDMLLLDEPTNHLDAESVEWLEQFLVRFPGTVVAVTHDRYFLDNAAEWILELDRGHGIPWKGNYSSWLEQKEKRLENEAKSEAARVKAMKQELEWVRQNAKGRQAKSKARLARFEEMSNYEYQKRNETQEIFIPVAERLGNEVIEFVNVSKSFGDKVLIDDLSFKVPAGAIVGIIGPNGAGKSTLFKMISGKEQPDSGEVKIGQTVKMSLIDQSREGLQNDKTVFDNIAEGRDILQVGQFEIPARQYLGRFNFKGSDQSKIAGQLSGGERGRLHLAKTLLSGGNVLLLDEPSNDLDVETLRALEDALLEFAGSVMVISHDRWFLDRIATHILACEGDSKWVFFDGNYQEYEADKKRRLGEEGAKPKRIKYKPVTR

SEQ ID NO: 1875 - DNA, 1677 bp, Neisseria meningitidis
atgtcccaacaatacgtctattctatgctgcgcgtgagcaaggttgtgccgccgcagaaaaccatcattaaagatatttccctttctttcttccccggcgcgaaaatcggtttgctcggtttgaacggcgcgggcaagtccaccgtgctgcggattatggcgggcgtggataaagaatttgagggcgaagccgtgccgatgggcggtattaaaatcggctacctgccgcaagagcctgagcttgatccggaaaaaaccgtgcgtgaggaagtggaaagcggtttgggcgaagtggctgccgcgcagaaacgtttggaggaagtgtatgccgagtacgccaatcccgatgcggattttgacgcgttggcggaagagcaggggcgtttggaagcgattattgcggcgggttcgtccacgggcggcggtgcggaacacgaattggaaatcgctgccgacgcgctgcgcctgccggaatgggatgccaaaatcgataatttgtccggcggtgaaaaacgccgcgtcgctttgtgcaaactcttgttgagcaagcccgatatgcttttgctggacgagccgaccaaccacttggatgcggaatcggtcgagtggctggagcaatttctcgtgcgcttccccggtacagtcgttgccgtaacacacgaccgctacttcctcgacaacgccgccgaatggattttggaactcgaccgcgggcacggtattccgtggaaaggaaattactcgtcttggttggagcagaaagaaaaacgtttggaaaacgaggcgaaatccgaagccgcgcgcgtgaaagcgatgaagcaggaattggaatgggtgcgccaaaatgccaaaggccgtcaagccaagtccaaagcgcgtttggcgcgttttgaagaaatgagcaactatgaataccaaaaacgcaatgaaacgcaggaaatcttcattcccgtcgccgagcgtttgggtaacgaagtgattgaatttgtgaatgtttccaaatcgttcggcgacaaagtgctgattgacgatttgagcttcaaagtgcctgcgggcgcgattgtcggcatcatcggtccgaacggcgcgggtaaatcgacactgtttaaaatgattgcgggcaaagagcagcccgattccggtgaagtgaaaatcgggcaaaccgtgaaaatgagcttgattgaccaaagccgcgaaggtttgcaaaacgacaaaaccgtgttcgacaacattgccgaaggtcgcgatattttacaggtcgggcagtttgaaatccccgcccgccaatatttgggacgcttcaatttcaaaggcagcgaccaaagcaaaatcacggggcagctttccggcggcgaacgcggacgtttgcacttggcaaaaaccttgttgggcggtggcaatgtgttgctgctggacgaaccgtccaacgacctcgacgtggaaaccctgcgcgcgttggaagacgcattgctggaatttgccggcagcgtgatggtgatttcgcacgaccgctggttcctcgaccgtattgctacgcatatcttggcttgcgaaggcgactccaaatgggtgttctttgacggcaactatcaggaatacgaagccgacaagaaacgccgactcggcgaagaaggcacgaaaccgaaacgcatcaaatacaaaccggtaacgcgttaa

SEQ ID NO: 1876 - protein, 558 aa, Neisseria meningitidis
MSQQYVYSMLRVSKVVPPQKTIIKDISLSFFPGAKIGLLGLNGAGKSTVLRIMAGVDKEFEGEAVPMGGIKIGYLPQEPELDPEKTVREEVESGLGEVAAAQKRLEEVYAEYANPDADFDALAEEQGRLEAIIAAGSSTGGGAEHELEIAADALRLPEWDAKIDNLSGGEKRRVALCKLLLSKPDMLLLDEPTNHLDAESVEWLEQFLVRFPGTVVAVTHDRYFLDNAAEWILELDRGHGIPWKGNYSSWLEQKEKRLENEAKSEAARVKAMKQELEWVRQNAKGRQAKSKARLARFEEMSNYEYQKRNETQEIFIPVAERLGNEVIEFVNVSKSFGDKVLIDDLSFKVPAGAIVGIIGPNGAGKSTLFKMIAGKEQPDSGEVKIGQTVKMSLIDQSREGLQNDKTVFDNIAEGRDILQVGQFEIPARQYLGRFNFKGSDQSKITGQLSGGERGRLHLAKTLLGGGNVLLLDEPSNDLDVETLRALEDALLEFAGSVMVISHDRWFLDRIATHILACEGDSKWVFFDGNYQEYEADKKRRLGEEGTKPKRIKYKPVTR

SEQ ID NO: 1877 - DNA, 1170 bp, Neisseria gonorrhoeae
atgctgcttcatgtcagcaattccctcaaacagcttcaggaagagcgtatccgccaagaacgtatccgccaagagcgtatccgtcaggcgcgcggcaaccttgcttccgtcaaccgcaaacagcgcgaggcttgggacaaattccaaaaactcaataccgagctgaaccgtttgaaaacggaagtcgccgctacgaaagcgcagatttcccgtttcgtatcggggaactataaaaacagccggccgaatgcggttgccctgttcctgaaaaacgccgaaccgggtcagaaaaaccgctttttgcgttatacgcgttatgtaaacgcctccaatcgggaagttgtcaaggatttggaaaaacagcagaaggctttggcggtacaagagcagaaaatcaacaatgagcttgcccgtttgaagaaaattcaggcaaacgtgcaatccctgctgaaaaaacagggtgtaaccgatgcggcggaacagacggaaagccgcagacagaatgccaaaatctccaaagatgcccgaaaactgctggaacagaaagggaacgagcagcagctgaacaagctcttgagcaatttggagaaaaaaaaagccgaacaccgcattcaggatgcggaagcaaaaagaaaattggctgaagccaaactggcggcagccgaaaaagccagaaaagaagcggcgcagcagaaggctgaagcgcgacgtgcggaaatgtccaacctgaccgccgaagacaggaacatccaagcgccttcggttatgggtatcggcagtgccgacggtttcagccgcatgcagggacgtttgaaaaaaccggttgacggtgtgccgaccgggcttttcgggcagaaccggagcggcggcgatgtttggaaaggcgtgttctattccactgcgcctgcaacggttgaaagcattgcgccgggaacggtaagctatgcggacgagttggacggctacggcaaagtggtcgtgatcgatcacggcgagaactacatcagcatctatgccggtttgagcgaaatttccgccggcaagggttatacggtcgcggcaggaagcaaaatcggcacgagcgggtcgctgccggacggggaagaggggctttacctgcaaatacgttatcgaggtcaggtgttgaacccttcgggctggatacgttga

SEQ ID NO: 1878 - protein, 389 aa, Neisseria gonorrhoeae
MLLHVSNSLKQLQEERIRQERIRQERIRQARGNLASVNRKQREAWDKFQKLNTELNRLKTEVAATKAQISRFVSGNYKNSRPNAVALFLKNAEPGQKNRFLRYTRYVNASNREVVKDLEKQQKALAVQEQKINNELARLKKIQANVQSLLKKQGVTDAAEQTESRRQNAKISKDARKLLEQKGNEQQLNKLLSNLEKKKAEHRIQDAEAKRKLAEAKLAAAEKARKEAAQQKAEARRAEMSNLTAEDRNIQAPSVMGIGSADGFSRMQGRLKKPVDGVPTGLFGQNRSGGDVWKGVFYSTAPATVESIAPGTVSYADELDGYGKVVVIDHGENYISIYAGLSEISAGKGYTVAAGSKIGTSGSLPDGEEGLYLQIRYRGQVLNPSGWIR

SEQ ID NO: 1879 - DNA, 1155 bp, Neisseria meningitidis
atgctgcttcatgtcagcaattccctcaaacagcttcaggaagagcgtatccgccaagagcgtatccgtcaggcgcgcggcaaccttgcttccgtcaaccgcaaacagcgcgaggcttgggacaagttccaaaaactcaataccgagctgaaccgtttgaaaacggaagtcgccgctacgaaagcgcagatttcccgtttcgtatcggggaactataaaaacagccagccgaatgcggttgccctgttcctgaaaaacgccgaaccgggtcagaaaaaccgctttttgcgttatacgcgttatgtaaacgcctccaatcgggaagttgtcaaggatttggaaaaacagcagaaggctttggcggtacaagagcagaaaatcaacaatgagcttgcccgtttgaagaaaattcaggcaaacgtgcaatctctgctgaaaaaacagggtgtaaccgatgcggcggaacagacggaaagccgcagacagaatgccaaaatcgccaaagatgcccgaaaactgctggaacagaaagggaacgagcagcagctgaacaagctcttgagcaatttggagaagaaaaaggccgaacaccgcattcaggatgcggaagcaaaaagaaaattggctgaagccagactggcggcagccgaaaaagccagaaaagaagcggcgcagcagaaggctgaagcacgacgtgcggaaatgtccaacctgaccgccgaagacaggaacatccaagcgccttcggttatgggtatcggcagtgccgacggtttcagccgcatgcaaggacgtttgaaaaaaccggttgacggtgtgccgaccggacttttcgggcagaaccggagcggcggcgatatttggaaaggcgtgttctattccactgcaccggcaacggttgaaagcattgcgccgggaacggtaagctatgcggacgagttggacggctacggcaaagtggtcgtggtcgatcacggcgagaactacatcagcatctatgccggtttgagcgaaatttccgtcggcaagggttatatggtcgcggcaggaagcaaaatcggctcgagcgggtcgctgccggacggggaagaggggctttacctgcaaatacgttatcaaggtcaggtattgaacccttcgagctggatacgttga

SEQ ID NO: 1880 - protein, 384 aa, Neisseria meningitidis
MLLHVSNSLKQLQEERIRQERIRQARGNLASVNRKQREAWDKFQKLNTELNRLKTEVAATKAQISRFVSGNYKNSQPNAVALFLKNAEPGQKNRFLRYTRYVNASNREVVKDLEKQQKALAVQEQKINNELARLKKIQANVQSLLKKQGVTDAAEQTESRRQNAKIAKDARKLLEQKGNEQQLNKLLSNLEKKKAEHRIQDAEAKRKLAEARLAAAEKARKEAAQQKAEARRAEMSNLTAEDRNIQAPSVMGIGSADGFSRMQGRLKKPVDGVPTGLFGQNRSGGDIWKGVFYSTAPATVESIAPGTVSYADELDGYGKVVVVDHGENYISIYAGLSEISVGKGYMVAAGSKIGSSGSLPDGEEGLYLQIRYQGQVLNPSSWIR

SEQ ID NO: 1881 - DNA, 1170 bp, Neisseria meningitidis
atgctgcttcatgtcagcaattccctcaagcagcttcaggaagagcgtatccgccaagaacgtatccgccaagagcgtatccgtcaggcgcgcggcaaccttgcttccgtcaaccgcaaacagcgcgaggcttgggacaagttccaaaaactcaataccgagctgaaccgtttgaaaacggaagtcgccgctacgaaagcgcagatttcccgtttcgtatcggggaactataaaaacagccagccgaatgcggttgccctgttcctgaaaaacgccgaaccgggtcagaaaaaccgctttttgcgttatacgcgttatgtaaacgcctccaatcgggaagttgtcaaggatttggaaaaacagcagaaggctttggcggtacaagagcagaaaatcaacaatgagcttgcccgtttgaagaaaattcaggcaaacgtgcaatccctgctgaaaaaacagggtgtaaccgatgcggcggaacagacggaaagccgcagacagaatgccaaaatcgccaaagatgcccgaaaactgctggaacagaaagggaacgagcagcagctgaacaagctcttgagcaatttggagaagaaaaaggccgaacaccgcattcaggatgcggaagcaaaaagaaaattggctgaagccagactggcggcagccgaaaaagccagaaaagaagcggcgcagcagaaggctgaagcacgacgtgcggaaatgtccaacctgaccgccgaagacaggaacatccaagcgccttcggttatgggtatcggcagtgccgacggtttcagccgcatgcaaggacgtttgaaaaaaccggttgacggtgtgccgaccggacttttcgggcagaaccggagcggcggcgatgtttggaaaggcgtgttctattccactgcaccggcaacggttgaaagcattgcgccgggaacggtaagctatgcggacgagttggacggctacggcaaagtggtcgtggtcgatcacggcgagaactacatcagcatctatgccggtttgagcgaaatttccgtcggcaagggttatatggtcgcggcaggaagcaaaatcggctcgagcgggtcgctgccggacggggaagaggggctttacctgcaaatacgttatcaaggtcaggtattgaacccttcgagctggatacgttga

SEQ ID NO: 1882 - protein, 389 aa, Neisseria meningitidis
MLLHVSNSLKQLQEERIRQERIRQERIRQARGNLASVNRKQREAWDKFQKLNTELNRLKTEVAATKAQISRFVSGNYKNSQPNAVALFLKNAEPGQKNRFLRYTRYVNASNREVVKDLEKQQKALAVQEQKINNELARLKKIQANVQSLLKKQGVTDAAEQTESRRQNAKIAKDARKLLEQKGNEQQLNKLLSNLEKKKAEHRIQDAEAKRKLAEARLAAAEKARKEAAQQKAEARRAEMSNLTAEDRNIQAPSVMGIGSADGFSRMQGRLKKPVDGVPTGLFGQNRSGGDVWKGVFYSTAPATVESIAPGTVSYADELDGYGKVVVVDHGENYISIYAGLSEISVGKGYMVAAGSKIGSSGSLPDGEEGLYLQIRYQGQVLNPSSWIR

SEQ ID NO: 1883 - DNA, 612 bp, Neisseria gonorrhoeae
atgttcccaaccggcaatttggtcgacgaaattgatgtgccgaatataggtcgtctgaaagccacgctcatcaacgcgggcattccgaccgttttcctgaacgccgccgacttgggctacacgggcaaagagttgcaggacgacatcaacaacgatgccgccgcgctggaaaaatttgaaaccatccgcgcatatggcgcgctgaaaatgggtttgatcagcgacgtatccgaagccgccgcccgcgcgcgcacgccgaaacccgccttcgtcgcgcccgccgccgattacaccgcctccagcggcaaaaccgtaaacgccgccgacatcgatttgccggtacgcgccctgagcatgggcaaactgcaccacgctatgatgggcatcgcctcggtcgccatcgccgccgccgtgctcggtacgctggtcaaccttgccgcaggcggcggaacgcgtaaagaagtgcgcttcgggcatccgtcaggtacgctgcgtgtcggtgctgccgccgaatgtcaggacggacaatggacggccgccaaagcggtcatgagccgcagcgcacgcgtgattatggaaagttgggtgcgcgttcccgatgattgtttttga

SEQ ID NO: 1884 - protein, 203 aa, Neisseria gonorrhoeae
MFPTGNLVDEIDVPNIGRLKATLINAGIPTVFLNAADLGYTGKELQDDINNDAAALEKFETIRAYGALKMGLISDVSEAAARARTPKPAFVAPAADYTASSGKTVNAADIDLPVRALSMGKLHHAMMGIASVAIAAAVLGTLVNLAAGGGTRKEVRFGHPSGTLRVGAAAECQDGQWTAAKAVMSRSARVIMESWVRVPDDCF

SEQ ID NO: 1885 - DNA, 618 bp, Neisseria meningitidis
atgttcccaaccggcaatttggtcgatgaaattgatgtgccgaatataggccgtttgaaagccacgctcatcaacgcgggcattccgaccgttttcttgaatgccgccgacttgggctacacaggcaaagagttgcaagacgacatcaacaacgatgccgcggctttggaaaaattcgagaaaatccgcgcttacggtgcgctgaaaatgggtctgatcagcgacgtatccgaagctgccgctcgcgcgcacacgccgaaagtcgccttcgtcgcgcccgccgccgattacaccgcctccagtggcaaaaccgtgaacgccgccgacatcgatttgctggtacgcgccctgagcatgggcaaactgcaccacgcgatgatgggtaccgcctctgttgccattgcgaccgccgccgccgtacccggtacgctggtcaaccttgccgcaggcggcggaacgcgtaaagaagtgcgcttcgggcatccttccggcacattgcgcgtcggtgcagccgccgaatgtcaggacggacaatggacggccaccaaagcggtcatgagccgtagcgcacgcgtgatgatggaaggttgggtcagggtgcctgaggattgtttttaa

SEQ ID NO: 1886 - protein, 205 aa, Neisseria meningitidis
MFPTGNLVDEIDVPNIGRLKATLINAGIPTVFLNAADLGYTGKELQDDINNDAAALEKFEKIRAYGALKMGLISDVSEAAARAHTPKVAFVAPAADYTASSGKTVNAADIDLLVRALSMGKLHHAMMGTASVAIATAAAVPGTLVNLAAGGGTRKEVRFGHPSGTLRVGAAAECQDGQWTATKAVMSRSARVMMEGWVRVPEDCF

SEQ ID NO: 1887 - DNA, 618 bp, Neisseria meningitidis
atgttcccaaccggcaatttggtcgatgaaattgatgtgccgaatataggccgtttgaaagccacgctcatcaacgcgggcattccgaccgttttcctgaatgccgccgacttgggctacacgggcaaagagttgcaagacgacatcaacaacgatgccgcagctttggaaaaattcgagaaaatccgcgcttacggtgcgctgaaaatgggtctgatcagcgacgtatccgaagctgccgcccgcgcgcacacgccgaaagtcgccttcgtcgcgcccgccgccgattacaccgcctccagtggcaaaaccgtgaatgccgccgacatcgatttgctggtacgcgccctgagcatgggcaaattgcaccacgcgatgatgggtaccgcctctgttgccattgcgaccgccgccgccgtgcccggtacgctggtcaaccttgccgcaggcggcggaacgcgtaaagaagtgcgcttcgggcatccttccggcacattgcgcgtcggtgcagccgccgaatgtcaggacggacaatggacggccaccaaagcggttatgagccgcagcgcacgcgtgatgatggaaggttgggtcagggtgccggaagattgtttttaa

SEQ ID NO: 1888 - protein, 205 aa, Neisseria meningitidis; identical to SEQ ID NO: 1886

SEQ ID NO: 1889 - DNA, 348 bp, Neisseria gonorrhoeae
atgttgctccatcaatgcgacaaagcgcgacatatgcgtccctttctgctcggcgggcagataaaccgtcatcgtcaggcgagcaaccgtggattgtgttccttcggcggttttcagggtaatcgggaagcgcaggtctttaatgccgacctgattgatcggcaggttgcgcaaatctctgctggattgcacgtctgcaatggcgttcatgcgttgtttgtccttaatattcagataattattgagatgtgtgtattgtatggcaggcagatgccgtctgaaaaaacgctgtcggccgcctgcctgcaaatgcgagattatatcacttgcttttggcggctgcattga

SEQ ID NO: 1890 - protein, 115 aa, Neisseria gonorrhoeae
MLLHQCDKARHMRPFLLGGQINRHRQASNRGLCSFGGFQGNREAQVFNADLIDRQVAQISAGLHVCNGVHALFVLNIQIIIEMCVLYGRQMPSEKTLSAACLQMRDYITCFWRLH

SEQ ID NO: 1891 - DNA, 336 bp, Neisseria meningitidis
atgttgctccatcaatgcgacaaaacgcgacatatgcgtccccttctgctcagcaggcaggtaaaccgtcatggtcagacgggcaatggtggactggatgccttctgcagtttgcagggtaatcggaaagcgcaggtctttgataccgacctgattgatcggcagattgcgcaaatctcggctggattgcacgtctgcaatagtgttcatgagttgtttttccttaatattcatgtaattgttgagatgtgtgcatggtatggcgtttccgccggggaatataccgtcaatctgcaaatgcgagattatatcactcgcttttagcagctgcattga

SEQ ID NO: 1892 - protein, 110 aa, Neisseria meningitidis
MLLHQCDKTRHMRPLLLSRQVNRHGQTGNGGLDAFCSLQGNRKAQVFDTDLIDRQIAQISAGLHVCNSVHELFFLNIHVIVEMCAWYGVSAGEYTVNLQMRDYITRFQLH

SEQ ID NO: 1893 - DNA, 336 bp, Neisseria meningitidis
atgttgctccatcaatgcgacaaagcgcgacatatgcgtacccttctgctcggcaggcaggtaaaccgtcatggtcagacgggcaactgtggactggatgccttctgcagtttgcagggtaatcggaaagcgcaggtctttgataccgacctgattgatcggcagattgcgcaaatctcggctggattgcacgtctgcaatagtgttcatgagttgtttttccttaatattcatgtaattgttgagatgtgtgcatggtatggcgtttccaccggggaatataccgtcaatctgcaaatgcgagattatatcactcgcttttagcagctgcattga

SEQ ID NO: 1894 - protein, 110 aa, Neisseria meningitidis
MLLHQCDKARHMRTLLLGRQVNRHGQTGNCGLDAFCSLQGNRKAQVFDTDLIDRQIAQISAGLHVCNSVHELFFLNIHVIVEMCAWYGVSTGEYTVNLQMRDYITRFQLH

SEQ ID NO: 1895 - DNA, 1350 bp, Neisseria gonorrhoeae
atggattcccgcctgcgtgggaatgacgctaggaaatacggcatacgctttgcccaaagaggccgtctgaaacacactccgcccaacgcccatcctttttcagacggccccgcaccaaaaaaacaaccacaaactacaaggagaaacatcatgtccgaccaactcattcttgtcctgaactgcgtcagttcatcgctcaaaggcgccgttatcgaccgcaaaagcggcagcgtcgtcctaagctgcctcggggaacgcctgactacgcccgaagccgtcattaccttcaacaaagacggcaacaaacgccaagttcccctgagcggccgcaactgccacgccggcgcggtgggtatgctgttgaacgaactggaaaaacacggactgcacgaccgcatcaaagccatcggccgccgcatcgcccacggcggcgaaaaatatcacgagtccgtcctcatcgaccaagacgtccttgacgaactgaaagcctgcatcccgttcgccccgctgcacaaccccgccaacatcagcggcatcctcgccgcgcaggaacactttcccggcctgcccaacgtcggcgtgatggacacctcgttccaccaaaccatgccggagcgggcctacacttatgccgtgccgcgcgaattgcgcaaaaaatacgccttccgccgctacggtttccacggtaccggtatgcgttacgtcgcccctgaagccgcacgcatcttgggcaaacctctggaagacatccgcatgattattgcccacttaggcaacggcgcatctattaccgccgtcaaaaacggcaaatccgtcgataccggtatgggtttcacgccgatcgaaggtttggtaatgggtacacgttgcggcgacaccgatccgggcgtatacagctatccgactttccacgcagggatggatgttgcccaagttgatgaaatgctgaacgaaaaatcaggtttccccggtatttccgaacttcccaacgactgccgcaccctcgaaatcgccgccgacgaaggccgcgaaggcgcgcgcctcgccctcgaagtcatgacctgccgcctcgccaaatacatcgcttcgatggctgtggcctgcggcagtgttgacgcactcgtgttcaccggcggtatcggcgaaaactcgcgtaatatccgtgccaaaaccgtttcctatcttgatttcttgggtctgcacatcgacaccaaagccaatatggaaaaacgctacggcaattcgggcattatcagcccgaccgattcttctccggctgttttggtcgtcccgaccaatgaagaactgatgattgcctgcgacactgccgaacttgccggcatcttgtag

SEQ ID NO: 1896 - protein, 449 aa, Neisseria gonorrhoeae
MDSRLRGNDARKYGIRFAQRGRLKHTPPNAHPFSDGPAPKKQPQTTRRNIMSDQLILVLNCVSSSLKGAVIDRKSGSVVLSCLGERLTTPEAVITFNKDGNKRQVPLSGRNCHAGAVGMLLNELEKHGLHDRIKAIGRRIAHGGEKYHESVLIDQDVLDELKACIPFAPLHNPANISGILAAQEHFPGLPNVGVMDTSFHQTMPERAYTYAVPRELRKKYAFRRYGFHGTGMRYVAPEAARILGKPLEDIRMIIAHLGNGASITAVKNGKSVDTGMGFTPIEGLVMGTRCGDTDPGVYSYPTFHAGMDVAQVDEMLNEKSGFPGISELPNDCRTLEIAADEGREGARLALEVMTCRLAKYIASMAVACGSVDALVFTGGIGENSRNIRAKTVSYLDFLGLHIDTKANMEKRYGNSGIISPTDSSPAVLVVPTNEELMIACDTAELAGIL

SEQ ID NO: 1897 - DNA, 1352 bp, Neisseria meningitidis
ctgtcctcgcgtaggcggggacggaataacgatagaaaatgcggcatacgctttgcccaaagaggccgtctgaaacaccttgcgcctgatgtctgcctttttcagacgaccccacactaaaaaaacaaccacaaactacaaggagaaacatcatgtccgaccaactcatcctcgttctgaactgcggcagttcatcgctcaaaggcgccgttatcgaccgamaaagcggcagcgtcgtcctaagctgcctcggcgaacgcctgaccacgcccgaagccgtcattacgttcaacaaagacggcaacaaacgccaagttcccctgagcggccgaaattgccacgccggcgcggtgggtatgcttttgaacgaactggaaaaacacggtctgcacgaccgcatcaaagccatcggccaccgcatcgcccacggcggcgaaaaatacagcgagtctgttttgatcgaccaggccgtaatggacgaactcaatgcctgcattccgcttgcgccgctgcacaaccccgccaacatcagcggcatccttgccgcacaggaacatttccccggtctgcccaatgtcggcgtgatggatacttcgttccaccaaaccatgccggagcgtgcctacacttatgccgtgccgcgcgagttgcgtaaaaaatacgctttccgccgctacggtttccacggcaccagtatgcgttacgttgcccctgaagccgcacgcatcttgggcaaacctctggaagacatccgcatgattattgcccacttaggcaacggcgcatccattaccgccatcaaaaacggcaaatccgtcgataccagtatgggtttcacgccgatcgaaggtttggtaatgggtacacgttgcggcgacatcgatccgggcgtatacagctatctgacttcccacgccgggatggatgttgcccaagtggatgaaatgctgaacaaaaaatcaggtttgctcggtatttccgaactttccaacgactgccgcaccctcgaaatcgccgccgacgaaggccacgaaggcgcgcgcctcgccctcgaagtcatgacctaccgcctcgccaaatacatcgcttcgatggctgtgggctgcggcggcgttgacgcactcgtgttcaccggcggtatcggcgaaaactcgcgtaatatccgtgccaaaaccgtttcctatcttgatttcttgggtctgcacatcgacaccaaagccaatatggaaaaacgctacggcaattcgggcattatcagcccgaccgattcttctccggctgttttggttgtcccgaccaatgaagaactgatgattgcctgcgacactgccgaacttgccggcatcttgtag

SEQ ID NO: 1898 - protein, 450 aa, Neisseria meningitidis
  misc_feature (33)..(33): Xaa can be any naturally occurring amino acid
  misc_feature (75)..(75): Xaa can be any naturally occurring amino acid
LSSRRRGRNNDRKCGIRFAQRGRLKHLAPDVCXFSDDPTLKKQPQTTRRNIMSDQLILVLNCGSSSLKGAVIDRXSGSVVLSCLGERLTTPEAVITFNKDGNKRQVPLSGRNCHAGAVGMLLNELEKHGLHDRIKAIGHRIAHGGEKYSESVLIDQAVMDELNACIPLAPLHNPANISGILAAQEHFPGLPNVGVMDTSFHQTMPERAYTYAVPRELRKKYAFRRYGFHGTSMRYVAPEAARILGKPLEDIRMIIAHLGNGASITAIKNGKSVDTSMGFTPIEGLVMGTRCGDIDPGVYSYLTSHAGMDVAQVDEMLNKKSGLLGISELSNDCRTLEIAADEGHEGARLALEVMTYRLAKYIASMAVGCGGVDALVFTGGIGENSRNIRAKTVSYLDFLGLHIDTKANMEKRYGNSGIISPTDSSPAVLVVPTNEELMIACDTAELAGIL

SEQ ID NO: 1899 - DNA, 1352 bp, Neisseria meningitidis
ctgtcctcgcgtaggcggggacggaataacgatagaaaatgcggcatacgctttgcccaaagaggccgtctgaaacacactccgcccaacgcccatcctttttcagacgaccccacaccaaaaaacaaccacaaactacaaggagaaacatcatgtccgaccaactcattcttgttctgaactgcggcagttcatcgctcaaaggtgccgttatcgaccgcaaaagcggcagcgtcgtcctaagctgcctcggcgaacgcctgaccacgcccgaagccgtcattacgttcagcaaagacggcaacaaacgccaagttcccctgagcggccggaactgccacgccggcgcggtgggtatgctgttgaacgaactggaaaaacacgaactgcacgaccgcattcaagccgtcggccaccgcatcgcccacggcggcgaaaaatacagcgagtctgttttgatcgaccaggccgtaatggacgaactcaatgcctgcattccgcttgcgccgctgcacaaccccgccaacatcagcggcatcctcgccgcacaggaacatttccccggtctgcccaatgtcggcgtgatggatacttcgttccaccaaaccatgccggagcgtgcctacacttatgccgtgccgcgcgagttgcgtaaaaaatacgctttccgccgctacggtttccacggcaccagtatgcgttacgttgcccctgaagccgcatgcatcttgggcaaacctctggaagacatccgcatgattattgcccacttaggcaacggcgcatccattaccgccatcaaaaacggcaaatccgtcgataccagtatgggtttcacgccgatcgaaggtttggtaatgggtacgcgctgcggcgatatcgacccgggcgtatacagctatctgacttcacacgccggtttggatgttgcacaagttgatgaaatgctgaataaaaaatcaggcttgctcggtatttccgaactctccaacgactgccgcaccctcgaaatcgccgccgacgaaggccacgaaggcgcgcgcctcgccctcgaagttatgacctaccgcctcgccaaatacatcgcttcgatggctgtgggctgcggcggcgttgacgcactcgtgttcaccggcggtatcggcgaaaactcgcgtaatatccgtgccaaaaccgtttcctatcttgatttcttgggtctgcacatcgacaccaaagccaatatggaaaaacgctacggcaattcgggtattatcagcccgaccgattcttctccggctgttttggttgtcccgaccaatgaagaactgatgattgcctgcgacactgccgaacttgtcggcatcttgtag

SEQ ID NO: 1900 - protein, 450 aa, Neisseria meningitidis
  misc_feature (40)..(40): Xaa can be any naturally occurring amino acid
LSSRRRGRNNDRKCGIRFAQRGRLKHTPPNAHPFSDDPTXKKQPQTTRRNIMSDQLILVLNCGSSSLKGAVIDRKSGSVVLSCLGERLTTPEAVITFSKDGNKRQVPLSGRNCHAGAVGMLLNELEKHELHDRIQAVGHRIAHGGEKYSESVLIDQAVMDELNACIPLAPLHNPANISGILAAQEHFPGLPNVGVMDTSFHQTMPERAYTYAVPRELRKKYAFRRYGFHGTSMRYVAPEAACILGKPLEDIRMIIAHLGNGASITAIKNGKSVDTSMGFTPIEGLVMGTRCGDIDPGVYSYLTSHAGLDVAQVDEMLNKKSGLLGISELSNDCRTLEIAADEGHEGARLALEVMTYRLAKYIASMAVGCGGVDALVFTGGIGENSRNIRAKTVSYLDFLGLHIDTKANMEKRYGNSGIISPTDSSPAVLVVPTNEELMIACDTAELVGIL

SEQ ID NO: 1901 - DNA, 504 bp, Neisseria gonorrhoeae
atgcccgaagcgcacttctttacgcgttccgccgcctgcggcaaggttgaccagcgtaccgagcacggcggcggcgatggcgaccgaggcgatgcccatcatagcgtggtgcagtttgcccatgctcagggcgcgtaccggcaaatcgatgtcggcggcgtttacggttttgccgctggaggcggtgtaatcggcggcgggcgcgacgaaggcgggtttcggcgtgcgcgcgcgggcggcggcttcggatacgtcgctgatcaaacccattttcagcgcgccatatgcgcggatggtttcaaatttttccagcgcggcggcatcgttgttgatgtcgtcctgcaactctttgcccgtgtagcccaagtcggcggcgttcaggaaaacggtcggaatgcccgcgttgatgagcgtggctttcagacgacctatattcggcacatcaatttcgtcgaccaaattgccggttgggaacatactgccttcgccgtcggctggatctaa

SEQ ID NO: 1902 - protein, 167 aa, Neisseria gonorrhoeae
MPEAHFFTRSAACGKVDQRTEHGGGDGDRGDAHHSVVQFAHAQGAYRQIDVGGVYGFAAGGGVIGGGRDEGGFRRARAGGGFGYVADQTHFQRAICADGFKFFQRGGIVVDVVLQLFARVAQVGGVQENGRNARVDERGFQTTYIRHINFVDQIAGWEHTAFAVGWI

SEQ ID NO: 1903 - DNA, 507 bp, Neisseria meningitidis
atgcccgaagcgcacttctttacgcgttccgccgcctgcggcaaggttgaccagcgtaccgggtacggcggcggcggtcgcaatggcaacagaggcggtacccatcatcgcgtggtgcagtttgcccatgctcagggcgcgtaccagcaaatcgatgtcggcggcgttcacggttttgccactggaggcggtgtaatcggcggcgggcgcgacgaaggcgactttcggcgtgtgcgcgcgagcggcagcttcggatacgtcgctgatcagacccattttcagcgcaccgtaagcgcggattttctcgaatttttccaaagccgcggcatcgttgttgatgtcgtcttgcaactctttgcctgtgtagcccaagtcggcggcattcaagaaaacggtcggaatgcccgcgttgatgagcgtggctttcaaacggcctatattcggcacatcaatttcatcgaccaaattgccggttgggaacatactgccttcgccgtcggctggatc

SEQ ID NO: 1904 - protein, 169 aa, Neisseria meningitidis
MPEAHFFTRSAACGKVDQRTGYGGGGRNGNRGGTHHRVVQFAHAQGAYQQIDVGGVHGFATGGGVIGGGRDEGDFRRVRASGSFGYVADQTHFQRTVSADFLEFFQSRGIVVDVVLQLFACVAQVGGIQENGRNARVDERGFQTAYIRHINFIDQIAGWEHTAFAVGWI

SEQ ID NO: 1905 - DNA, 663 bp, Neisseria meningitidis
atgcccgaagcgcacttctttacgcgttccgccgcctgcggcaaggttgaccagcgtaccgggcacggcggcggcggtcgcaatggcaacagaggcggtacccatcatcgcgtggtgcaatttgcccatgctcagggcgcgtaccagcaaatcgatgtcggcggcattcacggttttgccactggaggcggtgtaatcggcggcgggcgcgacgaaggcgactttcggcgtgtgcgcgcgggcggcagcttcggatacgtcgctgatcagacccattttcagcgcaccgtaagcgcggattttctcgaatttttccaaagctgcggcatcgttgttgatgtcgtcttgcaactctttgcccgtgtagcccaagtcggcggcattcaggaaaacggtcggaatgcccgcgttgatgagcgtggctttcaaacggcctatattcggcacatcaatttcatcgaccaaattgccggttgggaacatactgccttcgccgtcggctggatcaagaaattcgatttgtacttcggctgccgggaacgttacgccgtcgagctcaaaatcgcctgtttccaaaactgcgccgttttgcatcggtacatgggcaataatggttttgccgatgtttttctgccagattttgactgtgcagatgccgtctga

SEQ ID NO: 1906 - protein, 220 aa, Neisseria meningitidis
MPEAHFFTRSAACGKVDQRTGHGGGGRNGNRGGTHHRVVQFAHAQGAYQQIDVGGIHGFATGGGVIGGGRDEGDFRRVRAGGSFGYVADQTHFQRTVSADFLEFFQSCGIVVDVVLQLFARVAQVGGIQENGRNARVDERGFQTAYIRHINFIDQIAGWEHTAFAVGWIKKFDLYFGCRERYAVELKIACFQNCAVLHRYMGNNGFADVFLPDFDCADAV

SEQ ID NO: 1907 - DNA, 1545 bp, Neisseria gonorrhoeae
atgatgaccgaaatgcaacaacgcgcccaactgcaccgccaaatttggaaaatcgccgacgaagtacgcggcgcggtggatggctgggactttaaacaatacgttctcggcacacttttctaccgctttatcagcgaaaacttcaccgactatatgcaggccggcgacagcagcattgattacgccgctatgccggacagcatcatcacgcccgaaatcaaagacgatgccgtcaaagtcaaaggctatttcatctaccccggccagcttttttgcaatattgccgccgaagcccatcaaaacgaagagctcaacaccaagctgaaagaaatctttaccgcgattgaaagctccgcctccggctacccgtccgaacaaggcatcaaaggcttgtttgacgacttcgacaccaccagcagccggctcggcagcaccgttgccgacaaaaacaaacgccttgccgccgtccttaaaggcgtggcggaactcgatttcggcaattttgaagaccaccgcatcgaccttttcggtgatgcctacgaatacctgatttccaactacgccgccaacgcaggcaaatccggcggcgaatttttcaccccgcaaagcgtctccaagctgattgcgcggctggcggtgcacgggcaggagaaagtcaacaaaatctacgaccccgcctgcggctcgggcagcctgctcttgcaggcgaaaaaacagtttgacgaacacatcatcgaagaaggcttcttcgggcaggaaatcaaccacaccacctacaacctcgcccgcatgaatatgtttctgcacaacgtcaattacaacaaattccacatcgaattgggcgacacgctgaccaaccccaaactcaaagacagcaaaccctttgatgccgtcgtctccaatccgccctattccatcgactggataggcagcgacgaccccaccttgatcaacgacgaccgctttgcccccgcaggcgtactcgcaccgaaatccaaagccgattttgccttcatcctgcacgcactgaactacctttccggcagaggccgcgccgctatcgtctcattccccggcattttctatcgcggcggcgcagagcagaaaatccgccaatatctggtggagggcaactatgtggaaaccgtgattgcccttgcgcccaatctcttttacggcacctgcatcgccgtcaatatcctggttttgtccaaacacaaagacaataccgacatccaattcatcgacgcaagcggcttctttaaaaaagaaaccaacaacaacgtcttaaccgaagaacacattgccgaaatcgtcaaactcttcgccgacaaagccgatgtgccgcatatcgcccaaaacgccgcccagcaaaccgtcaaagacaacggctacaacctcgccgtcagcagctatgtcgaagccgaagacacccgcgaggtcatcgacatcagacagctcaacgccgaaatcagcgaaaccgtcgccaaaatcgaacggctgcggcgtgaaattgacgaagtgattgcagagattgaaacctag

SEQ ID NO: 1908 - protein, 514 aa, Neisseria gonorrhoeae
MMTEMQQRAQLHRQIWKIADEVRGAVDGWDFKQYVLGTLFYRFISENFTDYMQAGDSSIDYAAMPDSIITPEIKDDAVKVKGYFIYPGQLFCNIAAEAHQNEELNTKLKEIFTAIESSASGYPSEQGIKGLFDDFDTTSSRLGSTVADKNKRLAAVLKGVAELDFGNFEDHRIDLFGDAYEYLISNYAANAGKSGGEFFTPQSVSKLIARLAVHGQEKVNKIYDPACGSGSLLLQAKKQFDEHIIEEGFFGQEINHTTYNLARMNMFLHNVNYNKFHIELGDTLTNPKLKDSKPFDAVVSNPPYSIDWIGSDDPTLINDDRFAPAGVLAPKSKADFAFILHALNYLSGRGRAAIVSFPGIFYRGGAEQKIRQYLVEGNYVETVIALAPNLFYGTCIAVNILVLSKHKDNTDIQFIDASGFFKKETNNNVLTEEHIAEIVKLFADKADVPHIAQNAAQQTVKDNGYNLAVSSYVEAEDTREVIDIRQLNAEISETVAKIERLRREIDEVIAEIET

SEQ ID NO: 1909 - DNA, 1545 bp, Neisseria meningitidis
atgatgaccgaaatgcaacaacgcgcccaactgcaccgccaaatttggaaaattgccgacgaagtacgcggcgcggtggatggctgggactttaaacaatacgttctcggcacacttttctaccgctttatcagcgaaaacttcaccgactatatgcaggcaggcgacagcagtattgattacgccgctatgccggacagcatcatcacgcccgaaatcaaagacgatgccgtcaaagttaaaggctatttcatctaccccggccagcttttttgcaatattgccgccgaagcccatcaaaacgaagagctcaacaccaagctgaaagaaatttttaccgcgattgaaagctccgcctccggctatccgtccgaacaggacatcaaaggcctgtttgacgacttcgacaccaccagcagccggctcggcagcactgttgccgacaagaacaaacgccttgccgccgtcctcaaaggcgtggcggaactcgatttcggcaattttgaaaaccaccacatcgaccttttcggcgatgcctacgaatacctgatttccaactacgctgccaacgcaggcaaatccggcggcgaatttttcaccccgcaaagcgtatccaagctgattgcgcggctggcggtgcacggacaggagaaagtcaacaaaatctacgacccagcttgcggctcgggcagtctgctcttgcaggcgaaaaaacagtttgacgagcacatcatcgaagaaggcttcttcgggcaggaaatcaaccacaccacctacaacctcgcccgcatgaacatgttcctgcacaacgtcaattacaaccaattccacatcgaattgggcgacacactgaccaacccaaagctcaaagacagcaaaccctttgatgccatcgtttccaatccgccttattccatcaactggataggcagcgacgaccccaccttaatcaacgacgaccgctttgcccccgcaggcgtacttgccccgaaatccaaagccgattttgccttcatcctgcacgcactgaactacctttccggcagaggccgcgccgccatcgtctcattccccggcattttctatcgcggcggcgcagaacagaaaatccgccaatatctggtggagggcaactacgtggaaaccgtgattgcccttgcgcccaatctcttttacggcaccggcatcgccgtcaatatcctggttttgtccaaacacaaagacaataccgacatccaattcatcgacgcaagcggcttctttaaaaaagaaaccaacaacaacgtcttaatcgaagaacacattgctgaaatcgtcaaactcttcgccgataaagccgatgtgccgcatatcgcccaaaacgctgcccagcaaaccgtcaaagacaacggctacaacctcgccgtcagcagctatgtcgaagccgaagacacacgcgaaattatcgacatcaaacagctcaacgccgaaatcggcgaaaccgtcgccaaaatcgaacggctgcggcgtgaaattgacgaagtgattgcagagattgaagcatga

SEQ ID NO: 1910 - protein, 514 aa, Neisseria meningitidis
MMTEMQQRAQLHRQIWKIADEVRGAVDGWDFKQYVLGTLFYRFISENFTDYMQAGDSSIDYAAMPDSIITPEIKDDAVKVKGYFIYPGQLFCNIAAEAHQNEELNTKLKEIFTAIESSASGYPSEQDIKGLFDDFDTTSSRLGSTVADKNKRLAAVLKGVAELDFGNFENHHIDLFGDAYEYLISNYAANAGKSGGEFFTPQSVSKLIARLAVHGQEKVNKIYDPACGSGSLLLQAKKQFDEHIIEEGFFGQEINHTTYNLARMNMFLHNVNYNQFHIELGDTLTNPKLKDSKPFDAIVSNPPYSINWIGSDDPTLINDDRFAPAGVLAPKSKADFAFILHALNYLSGRGRAAIVSFPGIFYRGGAEQKIRQYLVEGNYVETVIALAPNLFYGTGIAVNILVLSKHKDNTDIQFIDASGFFKKETNNNVLIEEHIAEIVKLFADKADVPHIAQNAAQQTVKDNGYNLAVSSYVEAEDTREIIDIKQLNAEIGETVAKIERLRREIDEVIAEIEA

SEQ ID NO: 1911 - DNA, 1545 bp, Neisseria meningitidis
atgatgaccgaaatacaacaacgcgcccaactgcaccgccaaatttggaaaattgccgacgaagtacgcggcgcggtggatggctgggacttcaaacaatacgttctcggcacacttttctaccgctttatcagcgaaaactttaccgactatatgcaggcaggcgacagcagtattgattacgccgctatgccggacagcatcatcacgcccgaaatcaaagacgatgccgtcaaagtcaaaggctatttcatctaccccggccagcttttttgcaatattgccgccgaagcccatcaaaacgaagagctcaacaccaagctgaaagaaatttttaccgcgattgaaagctccgcctccggctatccgtccgaacaagacattaaaggcctgtttgacgacttcgacaccaccagcagccggctcggcagcaccgttgccgacaagaacaaacgccttgccgccgtcctaaaaggcgtggcggaactcgatttcggcagttttgaagaccaccacatcgaccttttcggcgatgcctacgaatacctgatttccaactacgctgccaacgcaggcaaatccggcggcgaatttttcaccccgcaaagcgtatccaagctgattgcgcggctggcggtgcacgggcaggagaaagtaaacaaaatctacgacccagcttgcggctcgggcagcctgctcttgcaggcgaaaaaacagtttgacgagcacatcatcgaagaaggcttcttcgggcaggaaatcaaccacaccacctacaacctcgcccgcatgaatatgtttctgcacaacgtcaattacaacaaattccacatcgaattgggcgacacactgaccaatcccaaactcaaagacagcaaaccctttgatgccgtcgtttccaatccgccctattccatcaactggataggcagcggcgaccccaccttaatcaacgacgaccgctttgcccctgcaggcgtactcgccccgaaatccaaagccgattttgccttcattctgcacgcactgaactacctttccggcagaggccgcgccgccatcgtctcattccccggcattttctatcgcggcggcgcagagcagaaaatccgccaatatctggtggagggcaactacgtggaaaccgtcatcgcccttgcgcccaatctcttttacggcaccggcatcgccgtcaatatactggttttgtccaaacacaaagacaataccgacatccaattcatcgacgcaggcggcttctttaaaaaagaaaccaacaacaacgtcttaaccgaagaacacattgccgaaatcgtcaaactcttcgccgataaagccgatgtgccgcatatcgcccaaaacgccgcccagcaaaccgtcaaagacaacggctacaacctcgccgtcagcagctatgttgaacccgaagacacccgcgaaattatcgacatcaaacagcttaacgccgaaatcagcgaaaccgttgccaaaatcgaacggctgcggcgtgaaattgacgaagtgattgcagagattgaagcatga

SEQ ID NO: 1912 - protein, 514 aa, Neisseria meningitidis
MMTEIQQRAQLHRQIWKIADEVRGAVDGWDFKQYVLGTLFYRFISENFTDYMQAGDSSIDYAAMPDSIITPEIKDDAVKVKGYFIYPGQLFCNIAAEAHQNEELNTKLKEIFTAIESSASGYPSEQDIKGLFDDFDTTSSRLGSTVADKNKRLAAVLKGVAELDFGSFEDHHIDLFGDAYEYLISNYAANAGKSGGEFFTPQSVSKLIARLAVHGQEKVNKIYDPACGSGSLLLQAKKQFDEHIIEEGFFGQEINHTTYNLARMNMFLHNVNYNKFHIELGDTLTNPKLKDSKPFDAVVSNPPYSINWIGSGDPTLINDDRFAPAGVLAPKSKADFAFILHALNYLSGRGRAAIVSFPGIFYRGGAEQKIRQYLVEGNYVETVIALAPNLFYGTGIAVNILVLSKHKDNTDIQFIDAGGFFKKETNNNVLTEEHIAEIVKLFADKADVPHIAQNAAQQTVKDNGYNLAVSSYVEPEDTREIIDIKQLNAEISETVAKIERLRREIDEVIAEIEA

SEQ ID NO: 1913 - DNA, 681 bp, Neisseria gonorrhoeae
atgtccaaatttatcgccaaacaatcggtcggtgcggaagtcatcgacacgccgcgcaccgaagaagaagcctggcttctgaacactgtcgaagcccaagcgcggcaatggaatctgaaaacgccagaagtcgccatctaccactcccccgaacccaatgcctttgccacgggcgcatcgagaaacagctccctgatcgccgtcagcaccggtttgctcgaccatatgacgcgcgacgaagtggaagccgtgttggcgcacgaaatggcgcacgtcggcaacggcgacatggttacgctgacgctgattcaaggcgtggtcaatacctttgtcgtgttcctgtcgcgcattattgccaacctgattgcccgaaacaacgacggcagccagtcccagggaacttatttcctagtcagcatggtattccaaatcctgttcggcttccttgccagcctgattgtcatgtggttcagccgccaacgcgaataccgcgccgacgcgggcgcggcaaaactggtcggcgcaccgaaaatgatttccgccctgcaaaggcttaaaggcaacccggtcgatttgcccgaagaaatgaacgcaatgggcatcgccggagatacgcgcgactccctgctcagcacccacccttcgctggacaaccgaatcgcccgcctcaaatcgctttaa

SEQ ID NO: 1914 - protein, 226 aa, Neisseria gonorrhoeae
MSKFIAKQSVGAEVIDTPRTEEEAWLLNTVEAQARQWNLKTPEVAIYHSPEPNAFATGASRNSSLIAVSTGLLDHMTRDEVEAVLAHEMAHVGNGDMVTLTLIQGVVNTFVVFLSRIIANLIARNNDGSQSQGTYFLVSMVFQILFGFLASLIVMWFSRQREYRADAGAAKLVGAPKMISALQRLKGNPVDLPEEMNAMGIAGDTRDSLLSTHPSLDNRIARLKSL

SEQ ID NO: 1915 - DNA, 681 bp, Neisseria meningitidis
atgtccaaatttatcgccaaacaatcggtcggcgcggaagttatcgacacgccgcgcaccgaagaagaagcctggcttttgaacactgtcgaagcccaagcgcggcaatggaacctgaaaacgcccgaagtcgccatctaccactcccccgaacccaatgcctttgccacgggcgcatcgagaaacagctccctgatcgccgtcagcaccggtttgctcgaccatatgacgcgtgacgaagtggaagccgtattggcgcacgaaatggcacacgtcggcaacggcgatatggttacgctgacgctgattcaaggcgtggtcaatacctttgtcgtgttcctgtcgcgcattattgccaacctgattgcccgaaacaacgacggcagccagtcccagggaacttatttcctggtcagcatggtattccaaatcctgttcggcttccttgccagcttaattgtcatgtggttcagccgacaacgcgaataccgcgccgatgcgggcgcggcaaaactggtcggcgcgccgaaaatgatttccgccctgcaaaggctcaaaggcaacccggtcgatttgcccgaagaaatgaacgcaatgggcatcgccggagatacgcgcgactccctgctcagcacccacccttcgctggacaaccgtatcgcccgcctcaaatcgctttaa

SEQ ID NO: 1916 - protein, 226 aa, Neisseria meningitidis; identical to SEQ ID NO: 1914

SEQ ID NO: 1917 - DNA, 681 bp, Neisseria meningitidis
atgtccaaattcatcgccaaacaatcggtcggcgcggaagttatcgacacgccgcgcaccgaagaagaagcctggcttttgaacactgtcgaagcccaagcgcggcaatggaacctgaaaacgcccgaagtcgccatctaccactcccccgaacccaatgcctttgccacgggcgcatcgagaaacagctccctgatcgccgtcagcaccggtttgctcgaccatatgacgcgtgacgaagtggaagccgtattggcgcacgaaatggcacacgtcggcaacggcgatatggttacgctgacgctgattcaaggcgtggtcaatacctttgtcgtgttcctgtcgcgcattattgccaacctgattgcccgaaacaacgacggcagccagtcccagggaacttatttcctggtcagcatggtattccaaatcctgttcggcttccttgccagcttaattgtcatgtggttcagccgacaacgcgaataccgcgccgacgcgggcgcggcaaaactggtcggcgcgccgaaaatgatttccgccctgcaaaggcttaaaggcaacccggtcgatttgcccgaagaaatgaacgcaatgggcatcgccggagatacgcgcgactccctgctcagcacccacccttcgctggacaaccgaatcgcccgcctcaaatcgctttaa

SEQ ID NO: 1918 - protein, 226 aa, Neisseria meningitidis; identical to SEQ ID NO: 1914

SEQ ID NO: 1919 - DNA, 1380 bp, Neisseria gonorrhoeae
atgctgctcgacctcgaccgcttttccttttccgtcttcctgaaagaaatccgcctgctgaccgcccttgccctgcccatgctgttggcgcaggtcgcgcaggtgggcatcggtttcgtcgataccgtgatggcgggcggtgcgggcaaggaagatttggcggcggtggctttgggcagcagcgcgtttgccacggtttatattacctttatgggcattatggcggcgctgaacccgatgattgcccagctttacggcgcgggtaaaaccggtgaagcaggcgaaacggggcggcaggggatttggttcgggctgattttggggattttcggcatgattttgatgtgggcggcgattacgccgttccgcaactggctgactttgagcgattatgtggaaggcacaatggcgcagtatatgctgttcaccagcttggcgatgccggcggcaatggtacaccgcgcactgcacgcctacgcttccagcctgaaccgcccgcgcctgattatgttggtcagctttgcggcgtttgtgttgaacgtgccgctgaactatattttcgtttacggcaaattcggtatgcccgctttgggtggcgcaggttgcggcgtggcgacaatggcggtgttttggttcagcgcgctggcattgtggatttatatcgccaaggaaaaattcttccgcccgttcggactgacagcgaaattcggcaaaccggattgggcggtgttcaaacagatttggaaaatcggcgcgcccatcgggctgtcttattttttggaagccagcgcgttttcgtttatcgtgtttttgattgcgcctttcggcgaggattatgtggcggcgcagcaggtcggcatcagtttgtcggggattctctatatgattccgcaaagcgtcggctcggcagggacggtgcgcatcggcttttcgcttgggcggcgcgaattttcgcgggcgcgttatatttcaggagtgtcgctggtgtcgggctgggtgctcgccgtgattaccgtgctttccttggtattattccgttcgccgctggcaagcatgtacaacgatgatccggcagttttaagcatcgcctccaccgtcctgctgttcgccggcctgttccaaccggcagacttcacccaatgtatcgcgtcctatgccctgcgcggctacaaagtcaccaaggtgccgatgttcatccacgccgccgccttctggggctgcggcctgctgccgggctatctgctcgcctaccgtttcgatatgggcatttacggcttctggacggcattgattgcctcgctcaccatcgcagccgtcgccttggtgtggtgcttggaaaaatacagtatggagttggtcaaatcacacaaggccgtctga

SEQ ID NO: 1920 - protein, 459 aa, Neisseria gonorrhoeae
MLLDLDRFSFSVFLKEIRLLTALALPMLLAQVAQVGIGFVDTVMAGGAGKEDLAAVALGSSAFATVYITFMGIMAALNPMIAQLYGAGKTGEAGETGRQGIWFGLILGIFGMILMWAAITPFRNWLTLSDYVEGTMAQYMLFTSLAMPAAMVHRALHAYASSLNRPRLIMLVSFAAFVLNVPLNYIFVYGKFGMPALGGAGCGVATMAVFWFSALALWIYIAKEKFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVSGWVLAVITVLSLVLFRSPLASMYNDDPAVLSIASTVLLFAGLFQPADFTQCIASYALRGYKVTKVPMFIHAAAFWGCGLLPGYLLAYRFDMGIYGFWTALIASLTIAAVALVWCLEKYSMELVKSHKAV

SEQ ID NO: 1921 - DNA, 1380 bp, Neisseria meningitidis
atgctgctcgacctcaaccgcttttcctttcccgtcttcctgaaagaagtccgcctgctgaccactcttgccctgcccatgctgttggcgcaggtcgcgcaggtgggcatcggttttgtcgatactgtgatggcgggcggtgcgggcaaggaagacttggcggcggtggctttgggcagcagcgcgtttgccacggtttatattacctttatgggcattatggcggcgctgaacccgatgattgcccagctttacggcgcgggtaaaaccgacgaagtgggcgaaacggggcggcaggggatttggttcgggctgtttttgggcgtgttcggcatggtcttgatgtgggcggcgattacgccgttccgcaactggctgaccttgagcgattatgtggaaggcacgatggcgcagtatatgttgttcaccagcttggcgatgccggcggcaatggtacaccgcgcgctgcacgcctacacttccagcctgaaccgcccgcgcctgattatgttggtcagctttgcggcgtttgtgttgaacgtgccgctgaactatattttcgtttacggcaaattcggtatgcccgctttgggcggcgcaggctgcggactggcgacgatggcggtgttttggttcagcgcgctggcattgtggatttatatcgccaaggaaaatttcttccgcccattcggactgacggcgaaattcggcaaaccggattgggcggtgttcaaacagatttggaaaatcggcgcacccatcgggctgtcttattttttggaagccagcgcgttttcgtttatcgtgtttttgattgcgcctttcggcgaggattatgtggcggcgcagcaggtcggcatcagtttgtcggggattctctatatgattccgcaaagcgtcggctcggcggggacggtgcgcatcggcttttcgcttgggcggcgcgaattttcgcgggcgcgttatatttcgggcgtgtcactggtgttaggatggatgctcgccgtgattaccgtgctttccttggtattattccgttcgccgctggtaagtatgtacaacaatgatccggcggttttaagcatcgccgccaccgtcttactgttcgccggcttgttccaaccggcagacttcacccaatgtatcgcctcctacgccttgcgcggctacaaagttacaaaggtgccgatgttcatccacgccgccgccttttggggctgcggcctgctgccgggctatctgctcgcctaccgtttcaatatgggcatttacggcttctggacggcattgattgcctcgctcaccatcgccgccatcgccttggtgtggtgcttggaattgtgcagtagggagatggtcagatcgcataaggccgtctga

SEQ ID NO: 1922 - protein, 459 aa, Neisseria meningitidis
MLLDLNRFSFPVFLKEVRLLTTLALPMLLAQVAQVGIGFVDTVMAGGAGKEDLAAVALGSSAFATVYITFMGIMAALNPMIAQLYGAGKTDEVGETGRQGIWFGLFLGVFGMVLMWAAITPFRNWLTLSDYVEGTMAQYMLFTSLAMPAAMVHRALHAYTSSLNRPRLIMLVSFAAFVLNVPLNYIFVYGKFGMPALGGAGCGLATMAVFWFSALALWIYIAKENFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVLGWMLAVITVLSLVLFRSPLVSMYNNDPAVLSIAATVLLFAGLFQPADFTQCIASYALRGYKVTKVPMFIHAAAFWGCGLLPGYLLAYRFNMGIYGFWTALIASLTIAAIALVWCLELCSREMVRSHKAV

SEQ ID NO: 1923 - DNA, 1380 bp, Neisseria meningitidis
atgctgctcgacctcaaccgcttttccttttccgtcttcctgaaagaagtccgcctgctgaccgctcttgccctgcccatgctgttggcgcaggtcgcgcaggtgggcatcggttttgtcgataccgtgatggcgggcggtgcgggcaaggaagacttggcggcggtggctttgggcagcagcgcgtttgccacggtttatattacctttatgggcattatggcggcgctgaacccgatgattgcccagctttacggcgcgggtaaaaccgacgaagtgggcgaaacgggacggcaggggatttggttcgggctgtttttgggcgtgttcggcatggtcttgatgtgggcggcgattacgccgttccgcaactggctgaccttgagcgattatgtggaaggcacaatggcgcagtatatgctgttcaccagcttggcgatgccggcggcaatggtacaccgcgcactgcacgcctacgcctccagcctgaaccgcccgcgcctgattatgttggtcagctttgcggcgtttgtgttgaacgtgccgctgaactatattttcgtttacggcaaattcggtatgcccgctttgggcggcgcaggctgcggactggcgacgatggcggtgttttggttcagcgcgctggcattgtggatttatatcgccaaggaaaatttcttccgcccattcggactgacggcgaaattcggcaaaccggattgggcggtgttcaaacagatttggaaaatcggcgcacccatcgggctgtcttattttttggaagccagcgcgttttcgtttatcgtgtttttgattgcgcctttcggcgaggattatgtggcggcgcagcaggtcggcatcagtttgtcggggattctctatatgattccgcaaagcgtcggctcggcggggacggtgcgcatcggcttttcgcttgggcggcgcgaattttcgcgggcgcgttatatttcgggcgtgtcactggtgtcaggatggatgctcgccgtgattaccgtgctttccttggtattattccgttcgccgctggtaagtatgtacaacaatgatccggcggttttaagcatcgccgccaccgtcttactgttcgccggcttgttccaaccggcagacttcacccaatgtatcgcctcctacgccttgcgcggctacaaagttacaaaggtgccgatgttcatccacgccgccgccttttggggctgcggtctgctgccgggctacctgctcgcctaccgtttcgatatgggcatttacggcttctggacggcattgattgcctcgctcaccatcgccgccatcgccttggtgtggtgcttggaattgtgcagtagggagatggtcagatcgcataaggctgtctga

SEQ ID NO: 1924 - protein, 459 aa, Neisseria meningitidis
MLLDLNRFSFSVFLKEVRLLTALALPMLLAQVAQVGIGFVDTVMAGGAGKEDLAAVALGSSAFATVYITFMGIMAALNPMIAQLYGAGKTDEVGETGRQGIWFGLFLGVFGMVLMWAAITPFRNWLTLSDYVEGTMAQYMLFTSLAMPAAMVHRALHAYASSLNRPRLIMLVSFAAFVLNVPLNYIFVYGKFGMPALGGAGCGLATMAVFWFSALALWIYIAKENFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVSGWMLAVITVLSLVLFRSPLVSMYNNDPAVLSIAATVLLFAGLFQPADFTQCIASYALRGYKVTKVPMFIHAAAFWGCGLLPGYLLAYRFDMGIYGFWTALIASLTIAAIALVWCLELCSREMVRSHKAV

SEQ ID NO: 1925 - DNA, 567 bp, Neisseria gonorrhoeae
atgtccgccctcctccccatcatcaaccgcctgattctgcaaagcccggacagccgctcggaacttacctcctttgcaggcaaaacactgaccctgaacattgccgggctgaaactggcgggacgcatcacagaagacggtttgctctcggcgggaaacggctttgcagacaccgaaattaccttccgcaacagcgcgatacggaaaatcctccaaggcggcgaacccggggctggcgacatcaggctcgaaggcgacctcatcctcggcatcgcggtactgtccctgctcggcagcctgcgttcccgcgcatcggacgaattggcacggattttcggcacgcaggcaggcatcggcagccgtgccaccgacatcggacacggcatcaaacaaatcggcaggaacatcgccgaacaaatcggcggattttcccgcgaacccgagtccgcaaacaccggcaacgaagcccttgccgactgcctcgacgaaataagcagactgcgcgacggcgtggaacgcctcaacgaacgcctcgacaggctcgaacgcgacatttggatagactaa

SEQ ID NO: 1926 - protein, 188 aa, Neisseria gonorrhoeae
MSALLPIINRLILQSPDSRSELTSFAGKTLTLNIAGLKLAGRITEDGLLSAGNGFADTEITFRNSAIRKILQGGEPGAGDIRLEGDLILGIAVLSLLGSLRSRASDELARIFGTQAGIGSRATDIGHGIKQIGRNIAEQIGGFSREPESANTGNEALADCLDEISRLRDGVERLNERLDRLERDIWID

SEQ ID NO: 1927 - DNA, 567 bp, Neisseria meningitidis
atgtccgccctcctccccatcatcaaccgcctgattctgcaaagcccggacagccgctcggaacttgccgcctttgcaggcaaaacactgaccctgaacattgccgggctgaaactggcgggacgcatcacggaagacggtttgctctcggcgggaaacggctttgcagacaccgaaattaccttccgcaacagcgcggtacagaaaatcctccaaggaggcgaacccggggcgggcgacatcgggctcgaaggcgacctcatcctcggcatcgcggtactgtccctgctcggcagcctgcgttcccgcgcatcggacgaattggcacggattttcggcacgcaggcagacatcggcagccgtgccgccgacatcggacacggcatcaaacaaatcggcaggaacatcgccgaacaaatcggcggattttcccgcgaatccgagtccgcaaacatcggcaacgaagcccttgccgactgcctcgacgaaataagcagactgcgcgacggcgtggaacgcctcaacgaacgcctcgaccggctcgaacgcgacatttggatagactaa

SEQ ID NO: 1928 - protein, 188 aa, Neisseria meningitidis
MSALLPIINRLILQSPDSRSELAAFAGKTLTLNIAGLKLAGRITEDGLLSAGNGFADTEITFRNSAVQKILQGGEPGAGDIGLEGDLILGIAVLSLLGSLRSRASDELARIFGTQADIGSRAADIGHGIKQIGRNIAEQIGGFSRESESANIGNEALADCLDEISRLRDGVERLNERLDRLERDIWID

SEQ ID NO: 1929 - DNA, 567 bp, Neisseria meningitidis
atgtccgccctcctccccatcatcaaccgcctgattctgcaaagcccggacagccgctcggaacttgccgccttcgcaggcaaaacactgaccctgaacattgccgggttgaaactggcgggacgcatcacggaagacggtttgctctcggcgggaaacggctttgcagacaccgaaatcaccttccgcaacagcgcggtacagaaaatcctccaaggcggcgaacccggggcgggcgacatcgggctcgaaggcgacctcatcctcggcatcgcggtactgtccctgctcggcagcctgcgttcccgcgcatcggacgaattggcacggattttcggcacgcaggcagacatcggcagccgtgccgccgacatcggacacggcatcaaacaaatcggcaggaacatcgccgaacaaatcggcagattttcccgcgaacccgagtccgcaaacatcggcaacgaagcccttgccgactgcctcgacgaaataagcagactgcgcgacggcgtggaacgcctcaacgaacgcctcgaccggctcgaacgcgacatttggatagactaa

SEQ ID NO: 1930 - protein, 188 aa, Neisseria meningitidis
MSALLPIINRLILQSPDSRSELAAFAGKTLTLNIAGLKLAGRITEDGLLSAGNGFADTEITFRNSAVQKILQGGEPGAGDIGLEGDLILGIAVLSLLGSLRSRASDELARIFGTQADIGSRAADIGHGIKQIGRNIAEQIGRFSREPESANIGNEALADCLDEISRLRDGVERLNERLDRLERDIWID

SEQ ID NO: 1931 - DNA, 396 bp, Neisseria gonorrhoeae
atggttgtggatagactcgaaattctcgctctcgacgacgaaactcttgatgcgtttgtcggcaatcagcgaagtagcgacatcgcgcaccatatcttccacgaatttcgggttttcgtaggccttttcggtaacgtatttttcatcggggcgtttgagcaggccgtagagttggcagctcgcctgcgtttccacataatcgataacttcctcgataccgacttcggcatcggaagtcaggctgacggtaacgtgcgaacgctgattatgcgcgccatattgggaaatttctttggaacacgggcaaagcgaggttacgggaatcatgaccttcatactgtggccgtatgccccgtctttcatttcacccgtgaggctgacatcataatccagtaa

SEQ ID NO: 1932 - protein, 131 aa, Neisseria gonorrhoeae
MVVDRLEILALDDETLDAFVGNQRSSDIAHHIFHEFRVFVGLFGNVFFIGAFEQAVELAARLRFHIIDNFLDTDFGIGSQADGNVRTLIMRAILGNFFGTRAKRGYGNHDLHTVAVCPVFHFTREADIIIQ

SEQ ID NO: 1933 - DNA, 396 bp, Neisseria meningitidis
atggttgtggatagactcgaaattctcgctctcgacgacgaaactcttgatgcgtttgtcggcaatcagcgaagtagcgacatcgcgcaccatatcttccacgaatttcgggttttcgtaggctttttcggtaacgtatttttcatcggggcgtttgagcaggccgtagagttggcagctcgcctgcgcctccacataatcgatgacttcctcgataccgacttcggcatcggcagtcaggctgacggtaacgtgcgaacgctggttgtgcgcgccgtattgggaaatttctttggaacacgggcaaagcgaggttacgggaatcatgaccttcatactgtggccgtatgccccgtctttgatttcgcccgtgagacagacatcataatccagtaa

SEQ ID NO: 1934 - protein, 131 aa, Neisseria meningitidis
MVVDRLEILALDDETLDAFVGNQRSSDIAHHIFHEFRVFVGFFGNVFFIGAFEQAVELAARLRLHIIDDFLDTDFGIGSQADGNVRTLVVRAVLGNFFGTRAKRGYGNHDLHTVAVCPVFDFARETDIIIQ

SEQ ID NO: 1935 - DNA, 396 bp, Neisseria meningitidis
atggttgtggatagactcgaaattctcgctctcgacgacgaaactcttgatgcgtttgtcggcaatcagcgaagtagcgacatcgcgcaccatatcttccacgaatttcgggttttcgtaggctttttcggtaacgtatttttcatcggggcgtttgagcaggccgtagagttggcagctcgcctgcgcctccacataatcgatgacttcctcgataccgacttcggcatcggcagtcaggctgacggtaacgtgcgaacgctggttgtgcgcgccatattgggaaatttctttggaacacgggcaaagcgaggttacgggaatcatgaccttcatactgtggccgtatgcaccgtctttcatttcgcccgtgaggctgacatcataatccagtaa

SEQ ID NO: 1936 - protein, 131 aa, Neisseria meningitidis
MVVDRLEILALDDETLDAFVGNQRSSDIAHHIFHEFRVFVGFFGNVFFIGAFEQAVELAARLRLHIIDDFLDTDFGIGSQADGNVRTLVVRAILGNFFGTRAKRGYGNHDLHTVAVCTVFHFAREADIIIQ

SEQ ID NO: 1937 - DNA, 1017 bp, Neisseria gonorrhoeae
atgattggagggcttatgcaatttccttaccgcaatgttccggcttcgcgtatgcgccgtatgcgcagggatgatttttcacgccgcctgatgcgcgagcatatgctgaccgccgatgatttgatttatccggtgttcgtattggagggggcggcgcgcgaggaggatgtgccttctatgccgggcgtgaagcgtcagagtttggacaggctgctgtttacggcggaagaggcggtgaagctcggtattccgatgttggcactctttcccgtggttacggcaaacaaaaccgggcgtgcgcaggaggcgtacaatcccgaaggactcgtgccgtcaactgtccgagccttgcgcgagaggtttcccgaactggggattatgacggatgtcgcgctcgatccttatacggtgcacggtcaggacggactgacggacgaaaacggttacgtgatgaatgatgaaaccgtagaagtcttggtgaaacaggctttatgtcatgcagaggcgggcacgcaggtcgttgctccttccgatatgatggacgggcgtatcggcgccatccgcgaggctttggaggatgccggacatatccatacgcggattatggcatattccgccaaatatgcttctgcattctacggccctttccgtgatgcggtaggcagttcgggcaatttgggaaaggcagataaaaagacctatcagatggatcctgcaaataccgatgaggcgctgcatgaagtggcgctcgatattcaggaaggtgcggatatggtgatggtgaagcccggtttgccgtatttggacgttgtccgccgcgtgaaggacgagttcggcgtaccgacttatgcctatcaggtttcgggcgaatatgcgatgttgcaggcggcggttgccaacggctggctggacggcggcaaagtggttttggaaagcctgctggcattcaaacgtgcgggtgcggacgggattttgacctattacgccattgaggcggcaaagatgctgaagcgttga

SEQ ID NO: 1938 - protein, 338 aa, Neisseria gonorrhoeae
MIGGLMQFPYRNVPASRMRRMRRDDFSRRLMREHMLTADDLIYPVFVLEGAAREEDVPSMPGVKRQSLDRLLFTAEEAVKLGIPMLALFPVVTANKTGRAQEAYNPEGLVPSTVRALRERFPELGIMTDVALDPYTVHGQDGLTDENGYVMNDETVEVLVKQALCHAEAGTQVVAPSDMMDGRIGAIREALEDAGHIHTRIMAYSAKYASAFYGPFRDAVGSSGNLGKADKKTYQMDPANTDEALHEVALDIQEGADMVMVKPGLPYLDVVRRVKDEFGVPTYAYQVSGEYAMLQAAVANGWLDGGKVVLESLLAFKRAGADGILTYYAIEAAKMLKR

SEQ ID NO: 1939 - DNA, 1017 bp, Neisseria meningitidis
atgattggagggcttatgcagtttccttaccgcaatgttccggcttcgcgtatgcgccgtatgcgcagggacgatttttcacgccgcctgatgcgcgaacacacgctgaccgccgatgatttgatttatccggtgttcgtattggaggggtcggcgcgcgaggaggatgtgccttctatgccgggtgtgaagcgtcaaagtttggacaggctgctgtttacggcggaagaggcggtaaagctcggtattccgatgttggcactgttccccgtggttacggcaaacaaaaccgagcgtgcgcaggaggcgtacaatcccgaaggactcgtgccgtcaactgtccgcgccttgcgcgagaggtttcccgaactgggcattatgacggatgtcgcgctcgatccttatacggttcacggtcaggacgggctgacggacgaaaacggttatgtgatgaacgatgaaaccgtagaggttttggtcaagcaggctttgtgccacgctgaagcgggcgcgcaggtggttgccccttccgatatgatggacgggcgtatcggtgcgattcgcgaggcgttggaggatgccgggcatatccatacgcggattatggcgtattccgccaaatatgcttctgcattttacggccctttccgtgatgcggtaggcagttcgggcaatttgggcaaggcagataaaaagacctaccagatggatccggcaaataccgatgaggcgttgcacgaagtggcgttggacattcaggaaggtgcggatatggtaatggtcaagcccggtttgccgtatttggacgttgtccgccgcgtaaaggacgagttcggtgtgccgacttatgcctatcaggtttcgggagaatacgcgatgttgcaggcagcgattgccaacggctggctggacggcggcaaagtggttttggaaagcctgctggcattcaaacgtgcgggtgcggacgggattttgacctattacgctattgaggcggcaaagatgttgaagcgttga

SEQ ID NO: 1940 - protein, 338 aa, Neisseria meningitidis
MIGGLMQFPYRNVPASRMRRMRRDDFSRRLMREHTLTADDLIYPVFVLEGSAREEDVPSMPGVKRQSLDRLLFTAEEAVKLGIPMLALFPVVTANKTERAQEAYNPEGLVPSTVRALRERFPELGIMTDVALDPYTVHGQDGLTDENGYVMNDETVEVLVKQALCHAEAGAQVVAPSDMMDGRIGAIREALEDAGHIHTRIMAYSAKYASAFYGPFRDAVGSSGNLGKADKKTYQMDPANTDEALHEVALDIQEGADMVMVKPGLPYLDVVRRVKDEFGVPTYAYQVSGEYAMLQAAIANGWLDGGKVVLESLLAFKRAGADGILTYYAIEAAKMLKR

SEQ ID NO: 1941 - DNA, 1017 bp, Neisseria meningitidis
atgattggagggcttatgcagtttccttaccgcaatgtttcggcttcgcgtatgcgccgtatgcgcagggacgatttttcacgccgcctgatgcgcgagcatacgctgactgccgatgatttgatttatccggtgttcgtattggaggggtcggcgcgcgaggaggatgtgccttctatgccgggcgtgaagcgtcagagtttggacaggctgctgtttacggcggaagaggcggtaaagctcggtattccgatgttggcactgttccccgtggttacggcaaacaaaaccgagcgtgcgcaggaggcgtacaatcccgaaggactcgtgccgtcaactgtccgcgccttgcgcgagaggtttcccgaactgggcattatgacggatgtcgcgctcgatccttatacggtgcacggtcaggacgggctgacggacgaaaacggttatgtgatgaacgatgaaaccgtagaggttttggtcaagcaggctttgtgtcatgcagaggcaggcgcacaggtcgttgctccttccgatatgatggatgggcgtatcggtgcgattcgcgaggcgttggaggatgccgggcatatccatacgcggattatggcgtattccgccaaatatgcttctgcattttacggccctttccgtgatgcggtaggcagttcgggcaatttgggcaaggcagataaaaagacctaccagatggatccggcaaataccgatgaggcgttgcacgaagtggcgttggacattcaggaaggtgcggatatggtgatggtcaagcccggtttgccgtatttggacgttgtccgccgcgtgaaggacgagttcggcgtgccgacttatgcctatcaggtttcgggagaatacgcgatgctgcaggcggcggttgccaacggctggctggacggcggcaaagtggttttggaaagcctgctggcattcaaacgtgcgggtgcggatgggattttgacctattacgccattgaggcggcaaagatgctgaagcgttga

SEQ ID NO: 1942 - protein, 338 aa, Neisseria meningitidis
MIGGLMQFPYRNVSASRMRRMRRDDFSRRLMREHTLTADDLIYPVFVLEGSAREEDVPSMPGVKRQSLDRLLFTAEEAVKLGIPMLALFPVVTANKTERAQEAYNPEGLVPSTVRALRERFPELGIMTDVALDPYTVHGQDGLTDENGYVMNDETVEVLVKQALCHAEAGAQVVAPSDMMDGRIGAIREALEDAGHIHTRIMAYSAKYASAFYGPFRDAVGSSGNLGKADKKTYQMDPANTDEALHEVALDIQEGADMVMVKPGLPYLDVVRRVKDEFGVPTYAYQVSGEYAMLQAAVANGWLDGGKVVLESLLAFKRAGADGILTYYAIEAAKMLKR

SEQ ID NO: 1943 - DNA, 543 bp, Neisseria gonorrhoeae
atgccgtctgaaaacgggatgggaaaacggcagcttgcgggctgccgtttgttcgggaagttaagccttgttttcaggctgctgcccggactctgtcgaggcggtgtctgccggggcaggtgcttcggttttttcccgagtcggagcgtgcggcgcgttatcttccgccgcgtccgcattctcgcgcaggttgtggctgttatccttgggcgggctgggttgtttgcccgccataatttccagtacctgatcgcggtctatggtttcccattccatcagggctttgcacatcgtttccatcttgtcgcggttttcatcgaggattttgtaggcaacctgatactgctcgtccaaaatccggcggatttccgcgtcgatgtcctgctgggttttctcggaaatgttttgcgaacgggttacgctgcgccccaagaagacttcgccttcgttttccgcataaaccatcacgcccattttgtcgctcatgccgtagcgcgttaccatttcgcgtgccatttgggttgcgcgttcaaagtcgtttga

SEQ ID NO: 1944 - protein, 180 aa, Neisseria gonorrhoeae
MPSENGMGKRQLAGCRLFGKLSLVFRLLPGLCRGGVCRGRCFGFFPSRSVRRVIFRRVRILAQVVAVILGRAGLFARHNFQYLIAVYGFPFHQGFAHRFHLVAVFIEDFVGNLILLVQNPADFRVDVLLGFLGNVLRTGYAAPQEDFAFVFRINHHAHFVAHAVARYHFACHLGCAFKVV

SEQ ID NO: 1945 - DNA, 543 bp, Neisseria meningitidis
atgccgtctgaaaacgggatgggaaaacggcagcttgcgggctgccgtttgttcgggaagttaagccttgttttcaggctgctgctcggactctgtcgaagcggtgtctgccggggcaggtgcttcggtttcttcccgagtcggagcgtgcggcgcgttatcttccgccgcgtccgcattctcgcgcaggttgtggctgtaatctttgggcgggctgggttgtttgcccgccatgatttccagtacctgatcgcggtcgatggtttcccattccatcagggctttgcacatcgtttccatcttgtcgcggttttcatcgaggattttgtaggcaacctgatattgctcgtccaaaatccggcggatttccgcgtcgatgtcctgctgggttttctcggaaatgttttgcgaacgggttacgctgcgtcccaagaagacttcgccttcgttttccgcataaaccatcacgcccattttgtcgctcatgccgtagcgcgttaccatttcgcgcgccatttgggttgcgcgttcaaagtcgtttga

SEQ ID NO: 1946 - protein, 180 aa, Neisseria meningitidis
MPSENGMGKRQLAGCRLFGKLSLVFRLLLGLCRSGVCRGRCFGFFPSRSVRRVIFRRVRILAQVVAVIFGRAGLFARHDFQYLIAVDGFPFHQGFAHRFHLVAVFIEDFVGNLILLVQNPADFRVDVLLGFLGNVLRTGYAASQEDFAFVFRINHHAHFVAHAVARYHFARHLGCAFKVV

SEQ ID NO: 1947 - DNA, 543 bp, Neisseria meningitidis
atgccgtctgaaaacaggatgggaaaacggcagcttgcgggctgccgtttgttcgggaagttaagccttgttttcaggctgctgctcggactctgtcgaagcggtgtctgccggggcaggtgcttcggtttcttcccgagtcggagcgtgcggcgcgttatcttccgccgcgtccgcattctcgcgcaggttgtggctgtaatctttgggcgggctgggttgtttgcccgccatgatttccagtacctgatcgcggtcgatggtttcccattccatcagggctttgcacatcgtttccatcttgtcgcggttttcatcgaggattttgtaggcaacctgatactgctcgtccaaaatccggcggatttccgcatcgatgtcctgctgggttttctcggaaatgttttgcgaacgggttacgctgcgtcccaagaagacttcgccttcgttttccgcataaaccatcacgcccattttgtcgctcatgccgtagcgcgttaccatttcgcgcgccatttgggttgcgcgttcaaagtcgtttga

SEQ ID NO: 1948 - protein, 180 aa, Neisseria meningitidis
MPSENRMGKRQLAGCRLFGKLSLVFRLLLGLCRSGVCRGRCFGFFPSRSVRRVIFRRVRILAQVVAVIFGRAGLFARHDFQYLIAVDGFPFHQGFAHRFHLVAVFIEDFVGNLILLVQNPADFRIDVLLGFLGNVLRTGYAASQEDFAFVFRINHHAHFVAHAVARYHFARHLGCAFKVV

SEQ ID NO: 1949 - DNA, 375 bp, Neisseria gonorrhoeae
atgggcttcggcggcaatattgcaaaaaagctggccggggtagatgaaatagcctttgactttgacggcatcgtctttgatttcgggcgtgatgatgctgtccggcatagcggcgtaatcaatgctgctgtcgccggcctgcatatagtcggtgaagttttcgctgataaagcggtagaaaagtgtgccgagaacgtattgtttaaagtcccagccatccaccgcgccgcgtacttcgtcggcgattttccaaatttggcggtgcagttgggcgcgttgttgcatttcggtcatcatcgaaatccatatataaagttaaacaaatcaaaatcgcctgatattttcagacgatttttttacgggcattcaaattaa

SEQ ID NO: 1950 - protein, 124 aa, Neisseria gonorrhoeae
MGFGGNIAKKLAGVDEIAFDFDGIVFDFGRDDAVRHSGVINAAVAGLHIVGEVFADKAVEKCAENVLFKVPAIHRAAYFVGDFPNLAVQLGALLHFGHHRNPYIKLNKSKSPDIFRRFFYGHSN

SEQ ID NO: 1951 - DNA, 374 bp, Neisseria meningitidis
atgggcttcggcggcaatattgcaaaaaagctggccggggtagatgaaatagcctttaactttgacggcatcgtctttgatttcgggcgtgatgatgctgtccggcatagcggcgtaatcaatactgctgtcgcctgcctgcatatagtcggtgaagttttcgctgataaagcggtagaaaagtgtgccgagaacgtattgtttaaagtcccagccatccaccgcgccgcgtacttcgtcggcaattttccaaatttggcggtgcagttgggcgcgttgttgcatttcggtcatcatcgaaatccatataaaagttaaacaaatcaaaatcgcctgatattttcagacgatttttttacgggcattcaaattaa

SEQ ID NO: 1952 - protein, 124 aa, Neisseria meningitidis
  misc_feature (104)..(104): Xaa can be any naturally occurring amino acid
MGFGGNIAKKLAGVDEIAFNFDGIVFDFGRDDAVRHSGVINTAVACLHIVGEVFADKAVEKCAENVLFKVPAIHRAAYFVGNFPNLAVQLGALLHFGHHRNPYXKLNKSKSPDIFRRFFYGHSN

SEQ ID NO: 1953 - DNA, 373 bp, Neisseria meningitidis
atgggcttcggcggcaatattgcaaaaaagctggccggggtagatgaaatagcctttgactttgacggcatcgtctttgatttcgggcgtgatgatgctgtccggcatagcggcgtaatcaatactgctgtcgcctgcctgcatatagtcggtaaagttttcgctgataaagcggtagaaaagtgtgccgagaacgtattgtttgaagtcccagccatccaccgcgccgcgtacttcgtcggcaattttccaaatttggcggtgcagttgggcgcgttgttgtatttcggtcatcatcgaaatccatataaaagttaaacaaatcaaaatcgcctgatattttcagacgattttttacgggcattcaaattaa

SEQ ID NO: 1954 - protein, 124 aa, Neisseria meningitidis
  misc_feature (104)..(104): Xaa can be any naturally occurring amino acid
  misc_feature (120)..(120): Xaa can be any naturally occurring amino acid
MGFGGNIAKKLAGVDEIAFDFDGIVFDFGRDDAVRHSGVINTAVACLHIVGKVFADKAVEKCAENVLFEVPAIHRAAYFVGNFPNLAVQLGALLYFGHHRNPYXKLNKSKSPDIFRRFFXGHSN

SEQ ID NO: 1955 - DNA, 615 bp, Neisseria gonorrhoeae
atgtcgcgttcgagcctgtcgaggcgttcgttgaggcgttccacgccgtcgcgcagtctgcttatttcgtcgaggcagtcggcaagggcttcgttgccggtgtttgcggactcgggttcgcgggaaaatccgccgatttgttcggcgatgttcctgccgatttgtttgatgccgtgtccgatgtcggtggcacggctgccgatgcctgcctgcgtgccgaaaatccgtgccaattcgtccgatgcgcgggaacgcaggctgccgagcagggacagtaccgcgatgccgaggatgaggtcgccttcgagcctgatgtcgccagccccgggttcgccgccttggaggattttccgtatcgcgctgttgcggaaggtaatttcggtgtctgcaaagccgtttcccgccgagagcaaaccgtcttctgtgatgcgtcccgccagtttcagcccggcaatgttcagggtcagtgttttgcctgcaaaggaggtaagttccgagcggctgtccgggctttgcagaatcaggcggttgatgatggggaggagggcggacatattttctgattggggcggagaatgcctgttgttgctgttgccgcttattttacaggcttaa

SEQ ID NO: 1956 - protein, 204 aa, Neisseria gonorrhoeae
MSRSSLSRRSLRRSTPSRSLLISSRQSARASLPVFADSGSRENPPICSAMFLPICLMPCPMSVARLPMPACVPKIRANSSDARERRLPSRDSTAMPRMRSPSSLMSPAPGSPPWRIFRIALLRKVISVSAKPFPAESKPSSVMRPASFSPAMFRVSVLPAKEVSSERLSGLCRIRRLMMGRRADIFSDWGGECLLLLLPLILQA

SEQ ID NO: 1957 - DNA, 615 bp, Neisseria meningitidis
atgtcgcgttcgagccggtcgaggcgttcgttgaggcgttccacgccgtcgcgcagtctgcttatttcgtcgaggcagtcggcaagggcttcgttgccgatgtttgcggactcggattcgcgggaaaatccgccgatttgttcggcgatgttcctgccgatttgtttgatgccgtgtccgatgtcggcggcacggctgccgatgtctgcctgcgtgccgaaaatccgtgccaattcgtccgatgcgcgggaacgcaggctgccgagcagggacagtaccgcgatgccgaggatgaggtcgccttcgagcccgatgtcgcccgccccgggttcgcctccttggaggattttctgtaccgcgctgttgcggaaggtaatttcggtgtctgcaaagccgtttcccgccgagagcaaaccgtcttccgtgatgcgtcccgccagtttcagcccggcaatgttcagggtcagtgttttgcctgcaaaggcggcaagttccgagcggctgtccgggctttgcagaatcaggcggttgatgatggggaggagggcggacatattttctgatcggggcggagaatgcctgttgttgctgttgccgcttattttacaggcttaa

SEQ ID NO: 1958 - protein, 204 aa, Neisseria meningitidis
MSRSSRSRRSLRRSTPSRSLLISSRQSARASLPMFADSDSRENPPICSAMFLPICLMPCPMSAARLPMSACVPKIRANSSDARERRLPSRDSTAMPRMRSPSSPMSPAPGSPPWRIFCTALLRKVISVSAKPFPAESKPSSVMRPASFSPAMFRVSVLPAKAASSERLSGLCRIRRLMMGRRADIFSDRGGECLLLLLPLILQA

SEQ ID NO: 1959 - DNA, 615 bp, Neisseria meningitidis
atgtcgcgttcgagccggtcgaggcgttcgttgaggcgttccacgccgtcgcgcagtctgcttatttcgtcgaggcagtcggcaagggcttcgttgccgatgtttgcggactcgggttcgcgggaaaatctgccgatttgttcggcgatgttcctgccgatttgtttgatgccgtgtccgatgtcggcggcacggctgccgatgtctgcctgcgtgccgaaaatccgtgccaattcgtccgatgcgcgggaacgcaggctgccgagcagggacagtaccgcgatgccgaggatgaggtcgccttcgagcccgatgtcgcccgccccgggttcgccgccttggaggattttctgtaccgcgctgttgcggaaggtgatttcggtgtctgcaaagccgtttcccgccgagagcaaaccgtcttccgtgatgcgtcccgccagtttcaacccggcaatgttcagggtcagtgttttgcctgcgaaggcggcaagttccgagcggctgtccgggctttgcagaatcaggcggttgatgatggggaggagggcggacatattttctgatcggggcggagaatgcctgttgttgctgttgacgcttattttacaggcttaa

SEQ ID NO: 1960 - protein, 204 aa, Neisseria meningitidis
MSRSSRSRRSLRRSTPSRSLLISSRQSARASLPMFADSGSRENLPICSAMFLPICLMPCPMSAARLPMSACVPKIRANSSDARERRLPSRDSTAMPRMRSPSSPMSPAPGSPPWRIFCTALLRKVISVSAKPFPAESKPSSVMRPASFNPAMFRVSVLPAKAASSERLSGLCRIRRLMMGRRADIFSDRGGECLLLLLTLILQA

SEQ ID NO: 1961 - DNA, 1176 bp, Neisseria gonorrhoeae
  misc_feature (960)..(960): n is a, c, g, or t
atggctgcgttcaacgctttggacggcaaaaaagaagacaacgggcaaatcgaatattctcagttcatccgacaggtcaacaacggcgaagtatccggcgtcaacatcgaaggatccgtcgtcagcggttacctgattaaaggcgagcgcaccgacaaaagcaccttcttcaccaacgcgcccttggatgacaacctgattcaaacccttttgaacaaaaacgtccgcgtaaaagtaacgccggaagaaaaaccgagcgcgctgactgccctgttttacagcctgctgcccgtcctgctgctgattggcgcatggttctactttatgcgtatgcaggcgggcggcggcggaaaaggcggcgcattctccttcggcaaaagccgcgcccgcctgctggacaaagatgccaacaaagttacctttgccgatgtcgccggctgcgacgaagccaaagaagaagtgcaggaaatcgtcgattacctcaaagcaccgaaccgctatcaaagcctcggcggccgtgttccgcgcggcatcctgctggcgggcagcccgggaaccggtaaaacactcttggcgaaagccattgcaggcgaggccggcgtgccgttcttcagcatttccggttccgattttgtcgaaatgttcgtcggtgtcggtgcaagccgcgtccgcgatatgttcgagcaggcaaagaaaaacgccccatgcattatctttatcgacgagattgacgcggtaggccgccaacgcggcgcaggtttgggcggcggcaatgatgagcgcgagcaaacattaaaccaattattggttgaaatggacggttttgagagcaatcagactgtaattgtgattgcggcaaccaaccgccccgacgtactcgatcctgcgctgcaacgccccggccgcttcgaccgccaagtcgtcgtccccctgccggacatccgggggcgcgaacagatnttgaacgtccattctaaaaaagtgcctttggacgaatctgtggatttattgtccctcgcgcgcggcacgcccggtttttccggcgcggatttggcgaaactggtcaacgaagcccccctgtttgccggccgccgcaacaaagtgaaagtcgatcaaagcgatttgaagacgccaaagacaaaatctatatgggtccggaacgccgcagtatggtga

SEQ ID NO: 1962 - protein, 391 aa, Neisseria gonorrhoeae
  misc_feature (320)..(320): Xaa can be any naturally occurring amino acid
MAAFNALDGKKEDNGQIEYSQFIRQVNNGEVSGVNIEGSVVSGYLIKGERTDKSTFFTNAPLDDNLIQTLLNKNVRVKVTPEEKPSALTALFYSLLPVLLLIGAWFYFMRMQAGGGGKGGAFSFGKSRARLLDKDANKVTFADVAGCDEAKEEVQEIVDYLKAPNRYQSLGGRVPRGILLAGSPGTGKTLLAKAIAGEAGVPFFSISGSDFVEMFVGVGASRVRDMFEQAKKNAPCIIFIDEIDAVGRQRGAGLGGGNDEREQTLNQLLVEMDGFESNQTVIVIAATNRPDVLDPALQRPGRFDRQVVVPLPDIRGREQXLNVHSKKVPLDESVDLLSLARGTPGFSGADLAKLVNEAPLFAGRRNKVKVDQSDLKTPKTKSIWVRNAAVW

SEQ ID NO: 1963 - DNA, 1176 bp, Neisseria meningitidis
atggctgcgttcaacgctttagacggtaaaaaagaagacaacgggcaaatcgaatactctcagttcatccaacaggtcaacaacggcgaagtatccggcgtcaacatcgaaggatccgtcgtcagcggctacctgattaagggcgagcgcaccgacaaaagcactttcttcaccaacgcgcctttggacgacaacctaattaaaacactgctcgacaaaaacgtccgcgtaaaagtaacgccggaagaaaaaccgagcgcgctggctgccctgttttacagcctgctgcccgtcctgctgctgattggcgcatggttctacttcatgcgtatgcagacgggcggcggcggaaaaggcggcgcattctcattcggtaaaagccgcgcccgcctgctggacaaagatgccaacaaagtgacctttgccgatgtcgccggctgcgacgaagccaaagaagaagtacaggaaatcgtcgattacctcaaagcgccgaaccgctatcaaagcctgggcgggcgcgtgccgcgcggcatcctgctggcgggcagcccgggtacgggtaagacgcttttggcgaaagcgattgcaggcgaagccggcgtgccgttcttcagcatttcaggttccgactttgtcgaaatgttcgtcggtgtcggtgcgagccgcgtccgcgatatgttcgagcaggcgaagaaaaacgccccctgcatcatctttatcgacgagattgacgcagtcggccgccaacgcggcgcaggtttgggcggcggcaatgatgagcgcgagcaaacattaaaccaattgttggttgaaatggacggttttgagagcaatcagactgtaattgtgattgcggcaaccaaccgccccgacgtactcgatcctgcgctgcaacgccccggccgtttcgaccgccaagtggttgtccccctgccggacatccgagggcgcgaacagattttgaacgtccattctaaaaaagtgcctttggacgaatctgtggatttattgtccctcgcgcgcggcacgccgggtttttccggcgcggatttggcgaacttggtcaacgaagccgccctgtttgccggccgccgcaataaagtcaaagtcgatcagagcgatttgaagacgccaaagacaaaatctatatgggtccggaacgccgcagtatggtga

SEQ ID NO: 1964 - protein, 391 aa, Neisseria meningitidis
MAAFNALDGKKEDNGQIEYSQFIQQVNNGEVSGVNIEGSVVSGYLIKGERTDKSTFFTNAPLDDNLIKTLLDKNVRVKVTPEEKPSALAALFYSLLPVLLLIGAWFYFMRMQTGGGGKGGAFSFGKSRARLLDKDANKVTFADVAGCDEAKEEVQEIVDYLKAPNRYQSLGGRVPRGILLAGSPGTGKTLLAKAIAGEAGVPFFSISGSDFVEMFVGVGASRVRDMFEQAKKNAPCIIFIDEIDAVGRQRGAGLGGGNDEREQTLNQLLVEMDGFESNQTVIVIAATNRPDVLDPALQRPGRFDRQVVVPLPDIRGREQILNVHSKKVPLDESVDLLSLARGTPGFSGADLANLVNEAALFAGRRNKVKVDQSDLKTPKTKSIWVRNAAVW

SEQ ID NO: 1965 - DNA, 1176 bp, Neisseria meningitidis
atggctgcgttcaacgctttagacggtaaaaaagaagacaacgggcaaatcgaatattctcagttcatccaacaggtcaacaacggcgaagtatccggcgtcaacatcgaaggatccgtcgtcagcggctacctgattaagggcgagcgcaccgacaaaagcaccttcttcaccaacgcgcctttggacgacaacctgattaaaacactgctcgacaaaaacgtccgtgtaaaagtaacgccggaagaaaaaccgagcgcgctggctgccctgttttacagcctgctgcccgtcctgctgctgattggcgcgtggttctactttatgcgtatgcagacgggcggcggcggaaaaggcggcgcattctcattcggcaaaagccgcgcccgcctactggacaaagatgccaacaaagttacctttgccgatgtcgccggctgcgacgaagccaaagaagaagtgcaggaaatcgtcgattacctcaaagcgccgaaccgctatcaaagcctgggcgggcgcgtgccgcgcggcatcctgctggcgggcagcccgggtacgggtaagacgcttttggcgaaagcgattgcaggcgaagccggcgtgccgttcttcagcatttcaggttccgactttgtcgaaatgttcgtcggtgtcggtgcaagccgcgtccgcgatatgttcgagcaggcgaagaaaaacgccccctgcatcatctttatcgacgagattgacgcagtcggccgccaacgcggcgcaggtttgggcggcggtaatgatgagcgcgagcaaacattaaaccaattgttggttgaaatggacggttttgagagcaatcagactgtaattgtgattgcggcaaccaaccgccccgacgtactcgatcctgcgctgcaacgccccggccgtttcgaccgccaagtggttgtccccctgccggacatccgggggcgcgaacagattttgaacgtccactctaaaaaagtgcctttggacaaatctgtggatttattgtccctcgcgcgcggcacgccgggtttttccggcgcggatttggcgaacttggtcaacgaagccgccctgtttgccggccgccgcaataaagtcaaagtcgatcagagcgatttgaagacgccaaagacaaaatctatatgggtccggaacgccgcagtatggtga

SEQ ID NO: 1966 - protein, 391 aa, Neisseria meningitidis
MAAFNALDGKKEDNGQIEYSQFIQQVNNGEVSGVNIEGSVVSGYLIKGERTDKSTFFTNAPLDDNLIKTLLDKNVRVKVTPEEKPSALAALFYSLLPVLLLIGAWFYFMRMQTGGGGKGGAFSFGKSRARLLDKDANKVTFADVAGCDEAKEEVQEIVDYLKAPNRYQSLGGRVPRGILLAGSPGTGKTLLAKAIAGEAGVPFFSISGSDFVEMFVGVGASRVRDMFEQAKKNAPCIIFIDEIDAVGRQRGAGLGGGNDEREQTLNQLLVEMDGFESNQTVIVIAATNRPDVLDPALQRPGRFDRQVVVPLPDIRGREQILNVHSKKVPLDKSVDLLSLARGTPGFSGADLANLVNEAALFAGRRNKVKVDQSDLKTPKTKSIWVRNAAVW

SEQ ID NO: 1967 - DNA, 1116 bp, Neisseria gonorrhoeae
atgtggaaacggcggcggcgcggtgtcggcagctttgaagagcagcgaatagatgccgccggcaaaccacaatgcggaaagcaggctgaagcggttgcgcggcagcttcatgccgcctcctcgtccagccacgtttggcagattttggacaggcgcaggaatttgccgccgcgtgcggcaagtatgtcgcgccattgtgccacttcttcggcggacggtgcttcgtcgatgctgcattcgtacagcaggaaatcgagggtttcttcgatgacggggatggattccgtttggataagctgcttgagttcgttcatgactgttcggatacggaaatcgggaaaatgccgtctgaaagggcttcagacggcattggattatttgctgtgcaggaagcgcgttgcctcttcccatttgccggaaatgatgtcgggtacggcctgcagggatttggcgacggcatcgtcgatttgccggcggtgcttccgcgctcggtttgttcaagacgtagccgacgacgaggttgcggtcgccggggtggccgatgccgaggcgcaggcggtaatagtctgccgtgccgagttttgcctgaatgtctttcaagccgttgtgtccgccgttgccgccgccgagtttgaatttgatccgtccgcaagggatgtcgagttcgtcgtggacgacgaggatttcttcgggtttgattttgtagaactgtgcaagcgcggcaaccgcctgtccggaacggttcatgaacgtggccggtttgagcagccaaacatcgccgtcgggcagggcggcgcgggcaacttcgccgaagaattttttttcttctttaaacgaagccttccatttccacgccagttcgtcgaggaaccaaaagcccgcattgtggcgggtctgttcgtattctttgcccgggttgcccaagccgacaaccattttgattgtgttcgacatgatattttccgtgtttctgtcgaatgcggtctgaaggcttcagacggcatggttattcttcttgattttgaacgcgtgtgcggcgcgcttctttggggtcgatcaacagcgggcggtacacttcgatgcggtcgccgtcgcgcagcggcgtgtcgtctttga

SEQ ID NO: 1968 - protein, 371 aa, Neisseria gonorrhoeae
MWKRRRRGVGSFEEQRIDAAGKPQCGKQAEAVARQLHAASSSSHVWQILDRRRNLPPRAASMSRHCATSSADGASSMLHSYSRKSRVSSMTGMDSVWISCLSSFMTVRIRKSGKCRLKGLQTALDYLLCRKRVASSHLPEMMSGTACRDLATASSICRRCFRARFVQDVADDEVAVAGVADAEAQAVIVCRAEFCLNVFQAVVSAVAAAEFEFDPSARDVEFVVDDEDFFGFDFVELCKRGNRLSGTVHERGRFEQPNIAVGQGGAGNFAEEFFFFFKRSLPFPRQFVEEPKARIVAGLFVFFARVAQADNHFDCVRHDIFRVSVECGLKASDGMVILLDFERVCGALLWGRSTAGGTLRCGRRRAAACRL

SEQ ID NO: 1969 - DNA, 1115 bp, Neisseria meningitidis
atgcggaaaaggcggtggcgcggtttcggcagctttgaaaagcagtgagtaaatgctgcctgcaaaccacaatgccgagagcaggataaagcggttgcgtggcagattcatgcttgttcctcttcaagccatgtctggcatagtttggataggcgcaggaattttccgccgcgtgcggccagcatatcgcgccaaacggcaatttcttcggcggagggggcatcgtctatgctgcattcgtagagcaggaaatcgagggtttcttcgatgacggggatggattcggtttggataagctgcttgagttcggtcatgactgttcggatatggaaatcgggaacatgccgtctgaaagggcttcagacggcatcgggtcatttgctgtgcaggaagcgggttgcttcttcccatttgccggcaaggatgtcgggtatggcttgcagggatttggcgacggcatcgtcaatctgtcggcggtgttccgtactgggtttgttcaggacatagccgacgacgaggttgcggtcgcccgggtggccgatgccgaggcgcaggcggtaatagtctgccgtgccgagttttgcctgaatgtctttcaagccgttgtgtccgccgttgccgccgccgagtttgaatttgatccgtccgcagggaatgtcgagttcgtcgtggacgacgaggatttcttcgggtttgattttgtagaactgtgcaagcgcggcaactgcctgtccggaacggttcatgaacgtggcaggtttgagcagccaaacgtcgccgtcgggcagggcggcacgggcgacttcgccgaagaattttttttcttctttaaatgaagccttccatttccacgccagttcgtcgaggaaccaaaaacccgcattgtggcgtgtctgttcgtattctttgcccgggttgcccaagccgacaaccattttgattgtgtttgacatgatattttccgtgtttctgtcgaatgctgtctgaaggcttcagacggcatggttattcttcttgattttgaacgcgtttgcggcgcgcttctttggggtcgatcaacagcgggcggtacacttcgatgcggtcgccgtcgcgcagcggcgtgtcgtctttga

SEQ ID NO: 1970 - protein, 371 aa, Neisseria meningitidis
  misc_feature (16)..(16): Xaa can be any naturally occurring amino acid
  misc_feature (81)..(81): Xaa can be any naturally occurring amino acid
  misc_feature (161)..(161): Xaa can be any naturally occurring amino acid
  misc_feature (279)..(279): Xaa can be any naturally occurring amino acid
  misc_feature (317)..(317): Xaa can be any naturally occurring amino acid
MRKRRWRGFGSFEKQXVNAACKPQCREQDKAVAWQIHACSSSSHVWHSLDRRRNFPPRAASISRQTAISSAEGASSMLHSXSRKSRVSSMTGMDSVWISCLSSVMTVRIWKSGTCRLKGLQTASGHLLCRKRVASSHLPARMSGMACRDLATASSICRRCXRTGFVQDIADDEVAVARVADAEAQAVIVCRAEFCLNVFQAVVSAVAAAEFEFDPSAGNVEFVVDDEDFFGFDFVELCKRGNCLSGTVHERGRFEQPNVAVGQGGTGDFAEEFFFFFKXSLPFPRQFVEEPKTRIVACLFVFFARVAQADNHFDCVXHDIFRVSVECCLKASDGMVILLDFERVCGALLWGRSTAGGTLRCGRRRAAACRL

SEQ ID NO: 1971 - DNA, 1115 bp, Neisseria meningitidis
atgcggaaacggcggcggcgcggtgtcggcagctttgaagagcagcgaatagatgccgccggcaaaccacaatgcggaaagcaggctgaagcggttgcgcggcagcttcatgccgcctcctcgtccagccacgtttggcagattttggacaggcgcaggaatttgccgccgcgtgcggcaagtatgtcgcgccattgtgccacttcttcggcggatggtgcgtcgtcgatgctgcattcgtacagcaggaaatcgagggtttcttcgatgacggggatggattcggtttggataagctgcttgagttcggtcatgactgttcggatatggaaatcgggaacatgccgtctgaaagggcttcagacggcatcgggtcatttgctgtgcaggaagcgggttgcctcttcacatttgccggcaaggatgtcgggtatggcttgcagggatttggcgacggcatcgtcaatctgtcggcggtgttccgtactgggtttgttcaggacatagccgacgacgaggttgcggtcgcccgggtggccgatgccgaggcgcaggcggtaatagtctgccgtgccgagttttgcctgaatgtctttcaagccgttgtgtccaccgttgccgccgccgagtttgaatttgatccgtccgcagggaatgtcgagttcgtcgtggacgacgaggatttcttcgggtttgattttataaaactgcgcaagggcggcaactgcctgtccggaacggttcatgaacgtggtcggcttgagcagccagacatcgccgtcgggcagggtagcacgggcgacttcgccgaagaattttttttcttctttaaatgaagccttccatttccacgccagttcgtcgaggaaccaaaaacccgcattgtggcgtgtctgttcgtattctttgcccgggttgcccaagccgacaaccattttgattgtgtttgacatgatattttccgtgtttctgccgaatgccgtctgaaggcttcagacggcatggttattcttcttgattttgaacgcgtttgcggcgcgcttctttggggtcgatcaacagcgggcggtacacttcgatgcggtcgccgtcgcgcagcggcgtgtcgtctttga

SEQ ID NO: 1972 - protein, 369 aa, Neisseria meningitidis
  misc_feature (160)..(160): Xaa can be any naturally occurring amino acid
MRKRRRRGVGSFEEQRIDAAGKPQCGKQAEAVARQLHAASSSSHVWQILDRRRNLPPRAASMSRHCATSSADGASSMLHSYSRKSRVSSMTGMDSVWISCLSSVMTVRIWKSGTCRLKGLQTASGHLLCRKRVASSHLPARMSGMACRDLATASSICRRXFRTGFVQDIADDEVAVARVADAEAQAVIVCRAEFCLNVFQAVVSTVAAAEFEFDPSAGNVEFVVDDEDFFGFDFIKLRKGGNCLSGTVHERGRLEQPDIAVGQGSTGDFAEEFFFFFKSLPFPRQFVEEPKTRIVACLFVFFARVAQADNHFDCVHDIFRVSAECRLKASDGMVILLDFERVCGALLWGRSTAGGTLRCGRRRAAACRL

SEQ ID NO: 1973 - DNA, 1206 bp, Neisseria gonorrhoeae
atgtcgaacacaatcaaaatggttgtcggcttgggcaacccgggcaaagaatacgaacagacccgccacaatgcgggcttttggttcctcgacgaactggcgtggaaatggaaggcttcgtttaaagaagaaaaaaaattcttcggcgaagttgcccgcgccgccctgcccgacggcgatgtttggctgctcaaaccggccacgttcatgaaccgttccggacaggcggttgccgcgcttgcacagttctacaaaatcaaacccgaagaaatcctcgtcgtccacgacgaactcgacatcccttgcggacggatcaaattcaaactcggcggcggcaacggcggacacaacggcttgaaagacattcaggcaaaactcggcacggcagactattaccgcctgcgcctcggcatcggccaccccggcgaccgcaacctcgtcgtcggctacgtcttgaacaaaccgagcgcggaagcaccgccggcaaatcgacgatgccgtcgccaaatccctgcaggccgtacccgacatcatttccggcaaatgggaagaggcaacgcgcttcctgcacagcaaataatccaatgccgtctgaagccctttcagacggcattttcccgatttccgtatccgaacagtcatgaacgaactcaagcagcttatccaaacggaatccatccccgtcatcgaagaaaccctcgatttcctgctgtacgaatgcagcatcgacgaagcaccgtccgccgaagaagtggcacaatggcgcgacatacttgccgcacgcggcggcaaattcctgcgcctgtccaaaatctgccaaacgtggctggacgaggaggcggcatgaagctgccgcgcaaccgcttcagcctgctttccgcattgtggtttgccggcggcatctattcgctgctcttcaaagctgccgacaccgcgccgccgccgtttccacatttcgacaaagcagcacaccttgccctgtttttcgcacaaatcttgtttctggccaaagcattcaaaaccggaaaacttcccatcccctaccgcagcctgattgcgttcgccttctgttttgccgtcggcagcgaatgcgcgcaggcatggtttaccgcaacgcgaaccggcagtttgggcgatgtccttgccgacctgacgggcgcagcccttgccctctttgccgcgcgttctgcctgccgcccggactaa

SEQ ID NO: 1974 - protein, 401 aa, Neisseria gonorrhoeae
MSNTIKMVVGLGNPGKEYEQTRHNAGFWFLDELAWKWKASFKEEKKFFGEVARAALPDGDVWLLKPATFMNRSGQAVAALAQFYKIKPEEILVVHDELDIPCGRIKFKLGGGNGGHNGLKDIQAKLGTADYYRLRLGIGHPGDRNLVVGYVLNKPSAEAPPANRRCRRQIPAGRTRHHFRQMGRGNALPAQQIIQCRLKPFQTAFSRFPYPNSHERTQAAYPNGIHPRHRRNPRFPAVRMQHRRSTVRRRSGTMARHTCRTRRQIPAPVQNLPNVAGRGGGMKLPRNRFSLLSALWFAGGIYSLLFKAADTAPPPFPHFDKAAHLALFFAQILFLAKAFKTGKLPIPYRSLIAFAFCFAVGSECAQAWFTATRTGSLGDVLADLTGAALALFAARSACRPD

SEQ ID NO: 1975 - DNA, 1205 bp, Neisseria meningitidis
atgtcaaacacaatcaaaatggttgtcggcttgggcaacccgggcaaagaatacgaacagacacgccacaatgcgggtttttggttcctcgacgaactggcgtggaaatggaaggcttcatttaaagaagaaaaaaaattcttcggcgaagtcgcccgtgccgccctgcccgacggcgacgtttggctgctcaaacctgccacgttcatgaaccgttccggacaggcagttgccgcgcttgcacagttctacaaaatcaaacccgaagaaatcctcgtcgtccacgacgaactcgacattccctgcggacggatcaaattcaaactcggcggcggcaacggcggacacaacggcttgaaagacattcaggcaaaactcggcacggcagactattaccgcctgcgcctcggcatcggccacccgggcgaccgcaacctcgtcgtcggctatgtcctgaacaaacccagtacggaacaccgccgacagattgacgatgccgtcgccaaatccctgcaagccatacccgacatccttgccggcaaatgggaagaagcaacccgcttcctgcacagcaaatgacccgatgccgtctgaagccctttcagacggcatgttcccgatttccatatccgaacagtcatgaccgaactcaagcagcttatccaaaccgaatccatccccgtcatcgaagaaaccctcgatttcctgctctacgaatgcagcatagacgatgccccctccgccgaagaaattgccgtttggcgcgatatgctggccgcacgcggcggaaaattcctgcgcctatccaaactatgccagacatggcttgaagaggaacaagcatgaatctgccacgcaaccgctttatcctgctctcggcattgtggtttgcaggcagcatttactcactgcttttcaaagctgccgaaaccgcgccaccgccttttccgcattttgacaaagtggcgcacctcgccctgtttttcgcacaaatctggcttctgaccaaagcattcagaaccgacaaccgccccatcccctatcgcagcctgatggtctttgccctctgtttcgccctcttcagcgaatgcgcgcaggcatggtttaccgcaacgagaaccggcagtttgggcgatgtccttgccgacctgacgggcgcagcccttgccctctttaccgcgcgagctgcctgccgcccggactaa

SEQ ID NO: 1976 - protein, 401 aa, Neisseria meningitidis
  misc_feature (159)..(159): Xaa can be any naturally occurring amino acid
  misc_feature (164)..(164): Xaa can be any naturally occurring amino acid
  misc_feature (277)..(277): Xaa can be any naturally occurring amino acid
MSNTIKMVVGLGNPGKEYEQTRHNAGFWFLDELAWKWKASFKEEKKFFGEVARAALPDGDVWLLKPATFMNRSGQAVAALAQFYKIKPEEILVVHDELDIPCGRIKFKLGGGNGGHNGLKDIQAKLGTADYYRLRLGIGHPGDRNLVVGYVLNKPSTEXPPTDXRCRRQIPASHTRHPCRQMGRSNPLPAQQMTRCRLKPFQTACSRFPYPNSHDRTQAAYPNRIHPRHRRNPRFPALRMQHRRCPLRRRNCRLARYAGRTRRKIPAPIQTMPDMAXRGTSMNLPRNRFILLSALWFAGSIYSLLFKAAETAPPPFPHFDKVAHLALFFAQIWLLTKAFRTDNRPIPYRSLMVFALCFALFSECAQAWFTATRTGSLGDVLADLTGAALALFTARAACRPD

SEQ ID NO: 1977 - DNA, 1205 bp, Neisseria meningitidis
atgtcaaacacaatcaaaatggttgtcggcttgggcaacccgggcaaagaatacgaacagacacgccacaatgcgggtttttggttcctcgacgaactggcgtggaaatggaaggcttcatttaaagaagaaaaaaaattcttcggcgaagtcgcccgtgctaccctgcccgacggcgatgtctggctgctcaagccgaccacgttcatgaaccgttccggacaggcagttgccgcccttgcgcagttttataaaatcaaacccgaagaaatcctcgtcgtccacgacgaactcgacattccctgcggacggatcaaattcaaactcggcggcggcaacggtggacacaacggcttgaaagacattcaggcaaaactcggcacggcagactattaccgcctgcgcctcggcatcggccacccgggcgaccgcaacctcgtcgtcggctatgtcctgaacaaacccagtacggaacaccgccgacagattgacgatgccgtcgccaaatccctgcaagccatacccgacatccttgccggcaaatgtgaagaggcaacccgcttcctgcacagcaaatgacccgatgccgtctgaagccctttcagacggcatgttcccgatttccatatccgaacagtcatgaccgaactcaagcagcttatccaaaccgaatccatccccgtcatcgaagaaaccctcgatttcctgctgtacgaatgcagcatcgacgacgcaccatccgccgaagaagtggcacaatggcgcgacatacttgccgcacgcggcggcaaattcctgcgcctgtccaaaatctgccaaacgtggctggacgaggaggcggcatgaagctgccgcgcaaccgcttcagcctgctttccgcattgtggtttgccggcggcatctattcgctgctcttcaaagctgccgacaccgcgccgccgccgtttccgcatttcgacaaagcagcacaccttgccctgtttttcgcacaaatctggcttttgaccaaagcattcaaaaccggaaaacttcccatcccctaccgcagcctgatggtctttgccctctgtttcgccctcttcagcgaatgcgcgcaggcatgatttaccgcaacgagaaccggcagtttgggcgatgttcttgccgatatggcaggtacggttctcgcactctttgccgcccgcgccgccgaccgcccggactga

SEQ ID NO: 1978 - protein, 398 aa, Neisseria meningitidis
  misc_feature (159)..(159): Xaa can be any naturally occurring amino acid
MSNTIKMVVGLGNPGKEYEQTRHNAGFWFLDELAWKWKASFKEEKKFFGEVARATLPDGDVWLLKPTTFMNRSGQAVAALAQFYKIKPEEILVVHDELDIPCGRIKFKLGGGNGGHNGLKDIQAKLGTADYYRLRLGIGHPGDRNLVVGYVLNKPSTEXPPTDRCRRQIPASHTRHPCRQMRGNPLPAQQMTRCRLKPFQTACSRFPYPNSHDRTQAAYPNRIHPRHRRNPRFPAVRMQHRRRTIRRRSGTMARHTCRTRRQIPAPVQNLPNVAGRGGGMKLPRNRFSLLSALWFAGGIYSLLFKAADTAPPPFPHFDKAAHLALFFAQIWLLTKAFKTGKLPIPYRSLMVFALCFALFSECAQAFTATRTGSLGDVLADMAGTVLALFAARAADRPD

SEQ ID NO: 1979 - DNA, 975 bp, Neisseria gonorrhoeae
atgccgtctgaaaaaaatatcggttttatggcaggaagcagccgtccgttgcgggtcgcctttgcgctgttgctggtttcctgcatcctgtttatgacgctcaacgtcaaaggagattgggactttgtcttgcacctgcgcctgaccaagcttgccgcgctgctgatggtcgcctatgcggtcggcgtgtccactcaactcttccaaacgctgaccaacaacccgattctgaccccttcgattttgggtttcgattcgctgtatgtgtttttgcagaccttgctggtgtttacgttcggcggcgtgggctatacatccctgccgttgacgggcaaattcggctttgaactggttgttatgatgggcggctcgctgctgctgttttacacgctcatccgtcagggcgggcgcgatttgccgcacatgattttaatcggcgtgattttcgggattttgttccgcagcctttcctcgctgctttcgcgcatgatagaccccgaagaatttaccgccgcgcaggcgaatatgtttgccggattcaataccgtccgcagcgagcttttaggcataggcgcgctggtcctgctcgtcagcgcggcggtcgtttggcacgaacgctaccgctcggacgtacaccttttggggcgcgaccaagccgtcaatttgggcatcagctacacgcgcaacaccttatggatactgctttggattgccgcattggtggcgacggcgaccgccgttgtcggcccggtgagctttttcgggcttctcgccgcctcgcttgccaaccacttttccccgtccgtgcgccattccgtccgcctgccgatgacggtttgcgtcggcggcatcctcttggtcggcggacaaaccgtattcgaacacttcttgggcatgaaggcggtattaagcgtggtggtcgaatttgcgggcggactcgttttcctctatctcgttttaaaacacaaaaaatga

SEQ ID NO: 1980 - protein, 324 aa, Neisseria gonorrhoeae
MPSEKNIGFMAGSSRPLRVAFALLLVSCILFMTLNVKGDWDFVLHLRLTKLAALLMVAYAVGVSTQLFQTLTNNPILTPSILGFDSLYVFLQTLLVFTFGGVGYTSLPLTGKFGFELVVMMGGSLLLFYTLIRQGGRDLPHMILIGVIFGILFRSLSSLLSRMIDPEEFTAAQANMFAGFNTVRSELLGIGALVLLVSAAVVWHERYRSDVHLLGRDQAVNLGISYTRNTLWILLWIAALVATATAVVGPVSFFGLLAASLANHFSPSVRHSVRLPMTVCVGGILLVGGQTVFEHFLGMKAVLSVVVEFAGGLVFLYLVLKHKK

SEQ ID NO: 1981 - DNA, 975 bp, Neisseria meningitidis
atgccgtctgaaaaaaatatcggttttatggcaggaagcagccgcccgttgtgggtcgcctttgcgctgttgctggtttcctgcgtcctgtttatgacgctcaacgtcaaaggcgattgggattttgttttgcaactgcggctgaccaaacttgccgcgctgctgatggtcgcctatgcggtcggcgtgtccacgcaactcttccaaacgctgaccaataatccgattctgaccccttcaattttgggtttcgattcgctgtatgtgtttttgcagaccttgctggtgtttacgttcggcggcgtgggctatgcttccctgccgttgacgggcaaattcggctttgaactggtcgtcatgatgggcggctcgctgctgctgttctacacgctcatcaaacagggcggacgcgatttgtcgcgcatgattttaatcggcgtgattttcgggattttgttccgcagcctgtcgtcgctgctttcgcgcatgatcgatcccgaagaatttaccgccgcgcaggcgaatatgtttgccggattcaataccgtccacagcgagcttttgggcataggcgcgctgattctgctcgtcagcgcggcggtcgtttggcgcgaacgctaccgcttggacgtttaccttttggggcgtgaccaagccgtcaatttgggcatcagctacacgcgcaacaccttatggatactgctttggattgccgcattggtggcgacggcgaccgccgtggtcggccccgtaagctttttcgggcttctcgccgcctcgcttgccaaccacttttccccgtcggtcaaacattccgtccgcctgccgatgacggtttgtatcggcggcatcctcttggtcggcggacagaccgtgttcgaacacctgctcggtatgcaggcagtgttgagcgtagtagtagaatttgccggcggactcgttttcctctatctcgttttaaaacacaaaaaatga

SEQ ID NO: 1982 - protein, 324 aa, Neisseria meningitidis
MPSEKNIGFMAGSSRPLWVAFALLLVSCVLFMTLNVKGDWDFVLQLRLTKLAALLMVAYAVGVSTQLFQTLTNNPILTPSILGFDSLYVFLQTLLVFTFGGVGYASLPLTGKFGFELVVMMGGSLLLFYTLIKQGGRDLSRMILIGVIFGILFRSLSSLLSRMIDPEEFTAAQANMFAGFNTVHSELLGIGALILLVSAAVVWRERYRLDVYLLGRDQAVNLGISYTRNTLWILLWIAALVATATAVVGPVSFFGLLAASLANHFSPSVKHSVRLPMTVCIGGILLVGGQTVFEHLLGMQAVLSVVVEFAGGLVFLYLVLKHKK

SEQ ID NO: 1983 - DNA, 975 bp, Neisseria meningitidis
atgccgtctgaaaaaaatatcggttttatggcaggaagcagccgtccgttgtgggttgcctttgcgctgttgctggtttcctgcatcctgtttatgacgctcaacgtcaaaggcgattgggattttgttttgcacctgcgcctgaccaagcttgccgcgctgctgatggtcgcctatgcggtcggcgtttcgacccagctttttcaaacgctgaccaacaatccgattctgaccccttcgattttgggtttcgattcgctgtatgtgtttttgcagaccttgctggtgtttacgttcggcggcgtgggctatgcttccctgccgttgacgggcaaattcggctttgaactggtcgttatgatgggcggctcgctgctgctgttttacacgctcatcaaacagggcgggcgcgatttgccgcgtatgattttaatcggcgtgattttcgggattttgttccgcagcctgtcgtcgctgctttcgcgcatgatcgaccccgaagaatttacggcggcgcaggcgaatatgtttgccggattcaataccgtccacagcgagcttttaggcataggcgcgctgattctgctcgtcagcgcggcggtcgtttggcgcgaacgctaccgcttggacgtacaccttttggggcgcgaccaagccataaatttgggcatcagctacacgcgcaacaccttatggatactgctttggattgccgcgctggtggcgacggcgaccgccgttgtcggcccggtaagctttttcgggcttctcgccgcctcgcttgccaaccacttttccccgtcggtcaaacattccgtccgcctgccgatgacggtttgtgtcggcggcatcctcttggtcggcggacagaccgtattcgaacacttcttgggcatgaaggcggtattaagcgtggtggtcgaatttgcgggcggactcgttttcctctatctcgttttaagacacaaaaaatga

SEQ ID NO: 1984 - protein, 324 aa, Neisseria meningitidis
MPSEKNIGFMAGSSRPLWVAFALLLVSCILFMTLNVKGDWDFVLHLRLTKLAALLMVAYAVGVSTQLFQTLTNNPILTPSILGFDSLYVFLQTLLVFTFGGVGYASLPLTGKFGFELVVMMGGSLLLFYTLIKQGGRDLPRMILIGVIFGILFRSLSSLLSRMIDPEEFTAAQANMFAGFNTVHSELLGIGALILLVSAAVVWRERYRLDVHLLGRDQAINLGISYTRNTLWILLWIAALVATATAVVGPVSFFGLLAASLANHFSPSVKHSVRLPMTVCVGGILLVGGQTVFEHFLGMKAVLSVVVEFAGGLVFLYLVLRHKK

SEQ ID NO: 1985 - DNA, 495 bp, Neisseria gonorrhoeae
atgaagaaaaccctgttggcaattgttgccgttttcgccttaagtgcctgccggcaggcggaagaggcaccgccgcctttaccccggcagattagcgaccgttcggtcggacactattgcagtatgaacctgaccgaacacaacggccccaaagcccagatttttttgaacggcaaacccgatcagcccgtttggttctccaccgtcaagcagatgttcggctataccaagctgcccgaagagcccaaaggcatccgcgtgatttacgttaccgatatgggcaatgttaccgattggacgaatcctaatgccgacacggagtggatagatgcgaaaaaagccttttacgtcatcgacagcggctttatcggcggtatgggcgcggaagacgcgctgccgttcggcaacaaggagcaggctgaaaaatttgcaaaggataaaggcggcaaggtcgtcggttttgacgatatgcccgatgcttacattttcaagtaa

SEQ ID NO: 1986 - protein, 164 aa, Neisseria gonorrhoeae
MKKTLLAIVAVFALSACRQAEEAPPPLPRQISDRSVGHYCSMNLTEHNGPKAQIFLNGKPDQPVWFSTVKQMFGYTKLPEEPKGIRVIYVTDMGNVTDWTNPNADTEWIDAKKAFYVIDSGFIGGMGAEDALPFGNKEQAEKFAKDKGGKVVGFDDMPDAYIFK

SEQ ID NO: 1987 - DNA, 495 bp, Neisseria meningitidis
atgaaaaaaaccctgttggcaattgttgccgtttccgccttaagtgcctgccggcaggcggaagagggaccgccgcctttaccccggcagattagcgaccgttcggtcggacactattgcagtatgaacctgaccgaacacaacggccccaaagcccagattttcttgaacggcaaacccgatcagcccgtttggttctccaccatcaagcagatgttcggctataccaagctgcccgaagagcctaaaggcatccgcgtgatttacgttaccgatatgggcaatgttaccgattggacgaatcccaatgccgacacggagtggatggatgcgaaaaaagccttttacgtcatcgacagcggctttatcggcggtatgggtgcggaagacgcgctgccgttcggcaacaaagagcaggctgagaaatttgcaaaggataaaggcggtaaggttgtcggtttcgacgatatgcctgatacctatattttcaaataa

SEQ ID NO: 1988 - protein, 164 aa, Neisseria meningitidis
MKKTLLAIVAVSALSACRQAEEGPPPLPRQISDRSVGHYCSMNLTEHNGPKAQIFLNGKPDQPVWFSTIKQMFGYTKLPEEPKGIRVIYVTDMGNVTDWTNPNADTEWMDAKKAFYVIDSGFIGGMGAEDALPFGNKEQAEKFAKDKGGKVVGFDDMPDTYIFK

SEQ ID NO: 1989 - DNA, 495 bp, Neisseria meningitidis; identical to SEQ ID NO: 1987

SEQ ID NO: 1990 - protein, 164 aa, Neisseria meningitidis; identical to SEQ ID NO: 1988

SEQ ID NO: 1991 - DNA, 1248 bp, Neisseria gonorrhoeae
atgcaacttaccgctgtcggactcaatcatcaaaccgcacctttaagcatacgggaaaagctggcgtttgccgccgccgccctgccagaagccgtccgcaatcttgcccgaagcaatgcggcaacggaggcggtaatcctttctacctgcaaccgcaccgagctttactgcgtcggcgattcggaagaaatcatccgatggcttgccgattaccacagtttgccgattgaagaaatccgtccgtatctgtacacgctggatatgcaggaaaccgtgcgccacgccttccgcgttgcctgcggcttggattcgatggttttgggcgagccgcagattttggggcagattaaagatgcggtgcgtgcggctcaagaacaggaaagtatgggggcaaaactcaatgccctgttccaaaaaaccttttccgttgctaaagaagtccgtaccgataccgctgtcggcgaaaattcggtttcgatggcttccgcgtccgtcaagttggcggaacagatttttcccgacatcggcgatttgaacgtattgtttatcggcgcaggcgaaatgattgagctggttgccacttattttgccgccaaaaatccccggctgatgacggttgccaaccggacgctggcgcgtgcacaggagttgtgcgacaagctcggtgttaacgccgaaccgtgcctgctgtccgatctgcctgccattctgcacgattacgacgtggtggtttcttcaacggcgagccagcttccgatagtcggcaaaggcatggtcgaacgcgcattgaaacagcgtcagagtatgccgttgttcatgcttgacttggccgtgccgcgcgatattgaagcggaagtcggcgatttgaacgatgcgtatctttatacggtggacgatatggtcaacatcgtccaaagcggcaaggaggcaaggcagaaagccgccgccgccgccgaaacgctggtgtccgaaaaggttgccgaatttgtcaggcagcagcagggcaggcagagcgttccgctgattaaggccttgcgggacgagggcgagaaagcgcgcaagcaggtgttggaaaatgcgatgaaacagcttgccaaaggcgcaacggcggaagaggttttggaacggctgtccgtccaactgaccaacaagctgctgcattcgccaactcaaaccttgaataaggcgggggaagaagataaagatttggttcatgccgtcgcgcagatttatcatttggacaaataa

SEQ ID NO: 1992 - protein, 415 aa, Neisseria gonorrhoeae
MQLTAVGLNHQTAPLSIREKLAFAAAALPEAVRNLARSNAATEAVILSTCNRTELYCVGDSEEIIRWLADYHSLPIEEIRPYLYTLDMQETVRHAFRVACGLDSMVLGEPQILGQIKDAVRAAQEQESMGAKLNALFQKTFSVAKEVRTDTAVGENSVSMASASVKLAEQIFPDIGDLNVLFIGAGEMIELVATYFAAKNPRLMTVANRTLARAQELCDKLGVNAEPCLLSDLPAILHDYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIKALRDEGEKARKQVLENAMKQLAKGATAEEVLERLSVQLTNKLLHSPTQTLNKAGEEDKDLVHAVAQIYHLDK

SEQ ID NO: 1993 - DNA, 1248 bp, Neisseria meningitidis
atgcaacttaccgctgtcggactcaatcatcaaaccgcacctttaagcatacgggaaaagctggcgtttgccgccgccgccctgcctaaagccgtccgcaatcttgcccgaagcaatgcggcaacggaggcggtaatcctttctacctgcaaccgcaccgagctttactgcgtcggtgattcggaagaaatcatccgatggcttgccgattaccacagtttgccgattgaagaaatccgtccgtatctgtacgcgctggatatgcaggagactgtgcgccatgctttccgcgtcgcctgcgggctggattcgatggtgttgggcgagccgcagattttaggacagattaaggatgccgttagggttgctcaagagcaggaaagtatgggtaagaaactcaatgccctgttccaaaaaaccttttccgttgctaaagaggtccgtaccgatactgccgtcggcgaaaactcggtttccatggcttccgcttccgtcaaattggcggaacagatttttcccgacatcggcgatttgaatgtcttgtttatcggcgcaggcgaaatgattgagctggttgccacttattttgccgccaaaagtccccggctgatgacggttgccaaccggacgctggcgcgtgcacaggagttgtgcgacaagctcggtgtcaacgccgaaccgtgcctgctgtccgatctgcctgccattctgcacgattacgacgtagtggtttcttcaacggcaagccagttgcccattgtcggcaaaggcatggtggagcgtgcattgaaacaaaggcagagtatgccgttgttcatgcttgatttggcagtgccgcgtgacattgaagcggaagtcggcgatttgaatgatgcctatctttatacggtggacgatatggtcaatatcgtccaaagcggcaaggaggcaaggcagaaggccgccgccgccgccgaaacgctggtgtccgagaaagttgccgaatttgtcaggcagcagcagggcaggcagagtgtccccttgattaaggcgttgcgggacgagggcgagaaagcgcgcaaacaggtgttggaaaatgccatgaaacagcttgccaaaggcgcaacggcagaagaggttttggaacggctgtccgtccaactgaccaacaagctgctgcattcgccgacccaaaccttgaataaggcgggggaagaagataaagatttggttcatgccgtcgcgcagatttatcatttggacaaataa

SEQ ID NO: 1994 - protein, 415 aa, Neisseria meningitidis
MQLTAVGLNHQTAPLSIREKLAFAAAALPKAVRNLARSNAATEAVILSTCNRTELYCVGDSEEIIRWLADYHSLPIEEIRPYLYALDMQETVRHAFRVACGLDSMVLGEPQILGQIKDAVRVAQEQESMGKKLNALFQKTFSVAKEVRTDTAVGENSVSMASASVKLAEQIFPDIGDLNVLFIGAGEMIELVATYFAAKSPRLMTVANRTLARAQELCDKLGVNAEPCLLSDLPAILHDYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIKALRDEGEKARKQVLENAMKQLAKGATAEEVLERLSVQLTNKLLHSPTQTLNKAGEEDKDLVHAVAQIYHLDK

SEQ ID NO: 1995 - DNA, 1248 bp, Neisseria meningitidis
atgcaacttaccgctgtcggactcaatcatcaaaccgcacctttaagcatacgggaaaagctggcgtttgccgcggcctgcctgcccgaagccgtccgcaatcttgcccgaagcaatgcggcaacggaggcggtaatcctttctacctgcaaccgtaccgagctttactgtgtaggtgattcggaagaaatcatccgttggctcgcagactatcacagccttcccatagaagaaatcagcccctacctttatactttggggatgcaggagactgtgcgccatgctttccgcgtcgcctgcggcttggattcgatggtgttgggcgagccgcagattttaggacagattaaggatgcggtcagggttgctcaagagcaggaaagtatgggtaagaaactcaatgccctgttccaaaaaaccttttctgttgctaaagaggtccgtaccgatactgccgtcggcgaaaactcggtttccatggcttccgcttccgtcaagttggcagagcagattttccccgacatcggcgatttgaatgtcttgtttatcggtgcgggtgagatgattgagctggttgccacttattttgccgccaaaagtccccggctgatgacggttgccaaccggacgctggcgcgtgcacaggagttgtgcgacaagctcggtgtcaacgccgaaccgtgcctgctgtccgatctgcctgccattttgcatgagtacgacgtggtggtttcttcaacggcaagccagttgcccattgtcggcaaaggtatggtggagcgcgcattgaaacaaaggcagagtatgccgttgtttatgcttgacttggccgtgccgcgagacattgaggcggaagtcggagatttgaacgatgcctatctttatacggtggacgatatggtcaatatcgtccaaagcggcaaggaggcaaggcagaaggccgccgccgccgccgaaacgctggtgtccgagaaggttgccgaatttgtcaggcagcagcagggcaggcagagtgtcccgttaatcagggcattgagggatgagggagagaaagcgcgcaaacaggtcttggaaaatgcgatgaaacagcttgccaaaggcgcaacggcagaagaggttttggaaaggctgtcgatccaactgaccaacaagctgctgcattcgccgacccaaaccttgaataaggcgggggaagaagataaagatttggttcacgccgtcgcgcagatttatcatttggacaaataa

SEQ ID NO: 1996 - protein, 415 aa, Neisseria meningitidis
MQLTAVGLNHQTAPLSIREKLAFAAACLPEAVRNLARSNAATEAVILSTCNRTELYCVGDSEEIIRWLADYHSLPIEEISPYLYTLGMQETVRHAFRVACGLDSMVLGEPQILGQIKDAVRVAQEQESMGKKLNALFQKTFSVAKEVRTDTAVGENSVSMASASVKLAEQIFPDIGDLNVLFIGAGEMIELVATYFAAKSPRLMTVANRTLARAQELCDKLGVNAEPCLLSDLPAILHEYDVVVSSTASQLPIVGKGMVERALKQRQSMPLFMLDLAVPRDIEAEVGDLNDAYLYTVDDMVNIVQSGKEARQKAAAAAETLVSEKVAEFVRQQQGRQSVPLIRALRDEGEKARKQVLENAMKQLAKGATAEEVLERLSIQLTNKLLHSPTQTLNKAGEEDKDLVHAVAQIYHLDK

SEQ ID NO: 1997 - DNA, 360 bp, Neisseria gonorrhoeae
  misc_feature (284)..(284): n is a, c, g, or t
atgatccgttatcttttaattgcctgcggcggcatctccctgctgttggggataatcggcatttttttgccgctgttgccgaccacgccgttcgtactactctccgccgcctgctgggcaaaggcatccccgcgctttcaccgctggctgcaccggcaccgctatttcggcccgatggttcataactgggaacaaaacggcgcagtgccgcgcaaagccaagattttcgccatcagcatgataaccgcatcctgcctcatgatcttttggcattttccccaacnctggtgggtcggggcggtttcatcggttttttgttcccttgtcaccatacggatgtggcacagacccgaatcttga

SEQ ID NO: 1998 - protein, 119 aa, Neisseria gonorrhoeae
  misc_feature (95)..(95): Xaa can be any naturally occurring amino acid
MIRYLLIACGGISLLLGIIGIFLPLLPTTPFVLLSAACWAKASPRFHRWLHRHRYFGPMVHNWEQNGAVPRKAKIFAISMITASCLMIFWHFPQXWWVGAVSSVFCSLVTIRMWHRPES

SEQ ID NO: 1999 - DNA, 360 bp, Neisseria meningitidis
atgatacgttatcttttaattgcctgcggctgcatttccctactgttgggtatcatcggcatttttttgccgctgttgccgaccacgccgttcgtactgctctccgccgcctgctgggcaaaggcatccccgcgcttttaccgctggctgcaccggcaccgctatttcggcccgatggttcataactgggaacaaaacggcgcagtgccgcgcaaagccaaaatattcgccatcagtatgatgaccgcatcctgcctgataatgttttggcagtttccccaacgctggtgggtcggggcggtttcatcggttttttgttcccttgtcgccatatggatgtggcgcaggcccgaatcttga

SEQ ID NO: 2000 - protein, 119 aa, Neisseria meningitidis
MIRYLLIACGCISLLLGIIGIFLPLLPTTPFVLLSAACWAKASPRFYRWLHRHRYFGPMVHNWEQNGAVPRKAKIFAISMMTASCLIMFWQFPQRWWVGAVSSVFCSLVAIWMWRRPES

SEQ ID NO: 2001 - DNA, 360 bp, Neisseria meningitidis
atgatacgttatcttttaattgcctgcggctgcatttccctgctgttgggtatcatcggcatttttttgccgctgttgccgaccacgccgttcgtactgctctccgccgcctgctgggcaaaggcatccccgcgctttcaccgctggctgcaccggcaccgctatttcggtccgatggttcataactgggaacaaaacggcgcagtgccgcgcaaagccaaaatattcgccatcagtatgatgaccgcatcctgcctgataatgttttggcagtttccccaacgctggtgggtcggggcggtttcatcggttttttgttcccttgtcgccatatggatgtggcgcaggcccgaatcttga

SEQ ID NO: 2002 - protein, 119 aa, Neisseria meningitidis
MIRYLLIACGCISLLLGIIGIFLPLLPTTPFVLLSAACWAKASPRFHRWLHRHRYFGPMVHNWEQNGAVPRKAKIFAISMMTASCLIMFWQFPQRWWVGAVSSVFCSLVAIWMWRRPES

SEQ ID NO: 2003 - DNA, 354 bp, Neisseria meningitidis
atgtttgcaaccaggaaaatgaagaagatgacgatgtgcacgcggcgggtacggttttggttggctttcagcagcggacgaatcatcagcattgctgcgccggtcgttcccatgatagaggcaagtgccgtaccgacggcaagcagggcggtgttgagcttgggtgtgccgttcaagtcgccccaaaccaaaatgccgcctgaaatggtgtacagggcaagcagcagcaggatgaaagggatgtattcttcaacgagtgcgtgtgcgacggtatggataccggcggacgcgccaaaaaccaaactgaacgggatgaggaagagcaatgtccaaaaggcggtaattttgccgtaa

SEQ ID NO: 2004 - protein, 117 aa, Neisseria gonorrhoeae
MFATRKMKKMTMCTRRVRSWLAFSSGRIISIAAPVVPMIEASAVPTASRAVLSLGVPFKSPQTKMPPEMVYRASSSRMKGIYSSTSACATVWIPADAPKTKLNGMRKSNVQKAVILP

SEQ ID NO: 2005 - DNA, 354 bp, Neisseria meningitidis; identical to SEQ ID NO: 2003

SEQ ID NO: 2006 - protein, 117 aa, Neisseria meningitidis
MFATRKMKKMTMCTRRVRFWLAFSSGRIISIAAPVVPMIEASAVPTASRAVLSLGVPFKSPQTKMPPEMVYRASSSRMKGMYSSTSACATVWIPADAPKTKLNGMRKSNVQKAVILP

SEQ ID NO: 2007 - DNA, 354 bp, Neisseria gonorrhoeae
atgtttgcaaccaggaaaatgaagaagatgacgatgtgcacgcggcgggtacggtcttggttggctttcagcagcggacgaatcatcagcattgccgcgccggtcgttcccatgatagaggcaagtgccgtaccgacggcaagcagggcggtgttgagcttgggtgtgccgttcaagtcgccccaaaccaaaatgccgcctgaaatggtgtacagggcaagcagcagcaggatgaaggggatatattcttcaacgagtgcgtgtgcgacggtatggataccggcggacgcgccaaaaaccaaactgaacgggatgaggaagagcaatgtccaaaaggcggtgattttgccgtaa

SEQ ID NO: 2008 - protein, 117 aa, Neisseria meningitidis; identical to SEQ ID NO: 2006

SEQ ID NO: 2009 - DNA, 633 bp, Neisseria gonorrhoeae
atgtccggcctttggaaacccgaacacccgggatttgaaatcctcggcagccgttacgccctgcaaaaccttgtccgcgatgtcatcctgattacattgaccgccgtatctatggcaatcacgcccaaacaagtccgcgcaggcaacgaattcaactttgaacccatcgccgaagtgggcaaactcttcctcggcatcttcatcaccatcttccccgtcctgagcattctgaaagcaggcgaggcaggcgcgctgggcggggtggtatcgctggttcacgatacggcaggtcatccgattaatacgatgtatttctggatgagcggcatattgtcggcattcttggataacgcgcccacttatctcgtgtttttcaatatggcgggcggcgatgcccaagccttaatgacgggtcccctgtttcattcgctgctggcggtttctatgggttcggtattcatgggcgcactgacctacatcggcaacgcaccgaacttcatggtcaaggccattgccgaacagcgcggcgtaccgatgccgactttcttccggtatatgatgtggtcggtcgccttcctgacacccgtcttcatcgtacataccctcgtctttttcgttttcaaactactgtaa

SEQ ID NO: 2010 - protein, 210 aa, Neisseria gonorrhoeae
MSGLWKPEHPGFEILGSRYALQNLVRDVILITLTAVSMAITPKQVRAGNEFNFEPIAEVGKLFLGIFITIFPVLSILKAGEAGALGGVVSLVHDTAGHPINTMYFWMSGILSAFLDNAPTYLVFFNMAGGDAQALMTGPLFHSLLAVSMGSVFMGALTYIGNAPNFMVKAIAEQRGVPMPTFFRYMMWSVAFLTPVFIVHTLVFFVFKLL

SEQ ID NO: 2011 - DNA, 633 bp, Neisseria meningitidis
atgtccggcctttggaaacccgaacacccgggatttgaaatcctcggcagccgttacgccctgcaaaacctcgtccgcgatgtcatcctgattgcattgaccgccgtatctatggcaatcacgcccaaacaagtccgcgcaggcaacgaattcaactttgaacccatcgccgaagtgggcaaactcttcctcggcatcttcatcaccatctttcccgtcctgagcattctgaaagcaggcgaggcaggcgcgctgggcggggtggtatcgctggttcacgatacggcaggtcatccgattaatgtgatgtatttttggatgagcggcatattgtcggcattcttggataacgcgcccacttatctcgtttttttcaatatggcgggcggcgatgcccaagccttgatgacgggtaccctgtttcattcgctgctggcggtttctatgggttcggtattcatgggcgcactgacctacatcggcaacgcaccgaacttcatggtcaaggccattgccgaacagcgcggcgtaccgatgccgactttcttcggctatatgatgtggtcggtcgccttcctgacacccgtcttcatcgtacatacccttatctttttcgttttcaaactgctgtaa

SEQ ID NO: 2012 - protein, 210 aa, Neisseria meningitidis
MSGLWKPEHPGFEILGSRYALQNLVRDVILIALTAVSMAITPKQVRAGNEFNFEPIAEVGKLFLGIFITIFPVLSILKAGEAGALGGVVSLVHDTAGHPINVMYFWMSGILSAFLDNAPTYLVFFNMAGGDAQALMTGTLFHSLLAVSMGSVFMGALTYIGNAPNFMVKAIAEQRGVPMPTFFGYMMWSVAFLTPVFIVHTLIFFVFKLL

SEQ ID NO: 2013 - DNA, 633 bp, Neisseria meningitidis
atgtccggcctttggaaacccgaacacccgggatttgaaatcctcggcagccgttacgccctgcaaaacctcgtccgcgatgtcatcctgattgcattgaccgccgtatctatggcaatcacgcccaaacaagtccgcgcaggcaacgaattcaactttgaacccatcgccgaagtgggcaaactcttcctcggcatcttcatcaccatctttcccgtcctgagcattctgaaagcaggcgaggcaggcgcgctgggcggggtggtatcgctggttcacgatacggcaggtcatccgattaatgtgatgtatttttggatgagcggcatattgtcggcattcttggataacgcgcccacttatctcgtttttttcaatatggcgggcggcgatgcccaagccttgatgacgggttccctgtttcattcgctgctggcggtttctatgggttcggtattcatgggcgcactgacctacatcggcaacgcaccgaacttcatggtcaaggccattgccgaacagcgcggcgtaccgatgccgactttcttcggctatatgatgtggtcggtcgccttcctgacacccgtcttcatcgtacatacccttatctttttcgttttcaaactgctgtaa

SEQ ID NO: 2014 - protein, 210 aa, Neisseria meningitidis
MSGLWKPEHPGFEILGSRYALQNLVRDVILIALTAVSMAITPKQVRAGNEFNFEPIAEVGKLFLGIFITIFPVLSILKAGEAGALGGVVSLVHDTAGHPINVMYFWMSGILSAFLDNAPTYLVFFNMAGGDAQALMTGSLFHSLLAVSMGSVFMGALTYIGNAPNFMVKAIAEQRGVPMPTFFGYMMWSVAFLTPVFIVHTLIFFVFKLL

SEQ ID NO: 2015 - DNA, 363 bp, Neisseria gonorrhoeae
atgtgcgtgccactcaagccggcaggatgcgggccgccaaattcatgtgtttcgatattggcagcattttcagacggcacgtctgcgcctgctgctttacacacatggattttacgttcggtcaggcggctcaataccaacaggccgcgtttgaagtcttcggcggcttctttgatgatgaccgtagggtcggcagccagcggattggtgtccatcgcattgacgaagatggcgaacggctcggcatctacggcagggattttgctgaacggacgggtgcgaagcgcagtccataagcctgattgaatcaggttgcggcgcactttttcgctgctcaattttgccagcgcttcaggtacgtag

SEQ ID NO: 2016 - protein, 119 aa, Neisseria gonorrhoeae
MCVPLKPAGCGPPNSCVSILAAFSDGTSAPAALHTWILRSVRRLNTNRPRLKSSAASLMMTVGSAASGLVSIALTKMANGSASTAGILLNGRVRSAVHKPDIRLRRTFSLLNFASASGT

SEQ ID NO: 2017 - DNA, 363 bp, Neisseria meningitidis
atgtgcgtgccactcaaaccggcaggatgcgggccgccgaattcatgtgtttcgatgttggcagcattttcagacggcacgtctgcgccagctgccttacaaacatggattttgcgttcggtcaaacggctcaataccaacaggccgcgtttgaaatcctcggcggcttctttgataatgaccgtagggtcggcagccagcggattggtgtccatcgcattgacgaagatggcgaacggctcggcatcgacggcaggaattttgctgaacggacgggtgcgcagcgcagtccacaaaccggattggatcaggttgcggcgcacttcttcgccgcttaagtttgccagcgcttcaggtgcgtag

SEQ ID NO: 2018 - protein, 120 aa, Neisseria meningitidis
MCVPLKPAGCGPPNSCVSMLAAFSDGTSAPAALQTWILRSVKRLNTNRPRLKSSAASLIMTVGSAASGLVSIALTKMANGSASTAGILLNGRVRSAVHKPDWIRLRRTSSPLKFASASGA

SEQ ID NO: 2019 - DNA, 363 bp, Neisseria meningitidis
atgtgcgtgccactcaaaccggccggatgcgggccgccgaattcatgtgtttcgatgttggcagcattttcagacggcacgtctgcgccagctgccttacacacatggattttacgctcggtcaaacggctcaataccagcaaacctcgtctgaaatcctcggcggcttctttgatcacaaccacagggtctgccgccagcggattggtgtccatcgcattgacgaagatggcgaacggctcggcatcgacggcagggattttgctgaacggacgggtacgcagcgcagtccacaaaccggattggatcagattgcggcgcacttcttcgccgcttaagtttgccaacgcttcgggcgcgtag

SEQ ID NO: 2020 - protein, 120 aa, Neisseria meningitidis
MCVPLKPAGCGPPNSCVSMLAAFSDGTSAPAALHTWILRSVKRLNTSKPRLKSSAASLITTTGSAASGLVSIALTKMANGSASTAGILLNGRVRSAVHKPDWIRLRRTSSPLKFANASGA

SEQ ID NO: 2021 - DNA, 968 bp, Neisseria gonorrhoeae
atgactgccaaacctttttccctcaacctggccaacctcctgctgccggcggtattgtttgccgtcagcctgtcggtcggcattgccgatttccgctggtcggatgtgttttcgctgtccgacagccagcaagtgatgttcatcagccgcctgccgcgcacgtttgcgattgtgttgacgggcgcgtcgatagcggtggcggggatgattatgcagattctgatgcgcaaccgttttgtcgagccttctatggcgggtgcgggccaaagtgcggctttgggtttgcttctgatgtccctgctgctgcctgccgcgccgctgccggtcaaaatgtcggtagccgccgttgccgcgctgatcgggatgttggtctttatgctgctaatccgccgcctgccaccgacggcgcagctgatggtgccgctggtggggttattttcggcggcgtggttgaggcggtggcgacgtttgtcgcgtatgagtttgagatgctgcaaatgttgggcgtgtggcagcagggcgacttttcaagcgtgctgctggggcggtacgagctgctttggattacgggcggtttggcggtgtttgcctacctgattgccgaccggctgacgattttggggctgggcgagacggtgagcgtgaatttgggtttgaaccggacggcggtgttgtggtcgggtttgattattgtggcactgattacatcgctggtcattgtaacggtcggcaatattccgtttatcgggctggtcgtgccgaatatcgtcagccgcctgatgggcgacaggctgcgccaaagcctgcctgcggtcgccctcttgggcgcgtctttggttttattgtgcgacattatcggacgcatgattgtgtttccgtttgaaattccggtctccacggtttttggtgtgttgggtacggctttgtttttgtggcttttgttgaggaaacccgcctatgccgtctga

SEQ ID NO: 2022 - protein, 322 aa, Neisseria gonorrhoeae
  misc_feature (145)..(145): Xaa can be any naturally occurring amino acid
MTAKPFSLNLANLLLPAVLFAVSLSVGIADFRWSDVFSLSDSQQVMFISRLPRTFAIVLTGASIAVAGMIMQILMRNRFVEPSMAGAGQSAALGLLLMSLLLPAAPLPVKMSVAAVAALIGMLVFMLLIRRLPPTAQLMVPLVGXIFGGVVEAVATFVAYEFEMLQMLGVWQQGDFSSVLLGRYELLWITGGLAVFAYLIADRLTILGLGETVSVNLGLNRTAVLWSGLIIVALITSLVIVTVGNIPFIGLVVPNIVSRLMGDRLRQSLPAVALLGASLVLLCDIIGRMIVFPFEIPVSTVFGVLGTALFLWLLLRKPAYAV

SEQ ID NO: 2023 - DNA, 969 bp, Neisseria meningitidis
atgactgccaaacctttttccctcaacctgaccaacctgctgctgctggcggtgttgtttgccgtcagcctgtcggtgggcgttgccgatttccgctggtctgatgtgttttcactgtccgacagccagcaggtcatgttcatcagccgcctgccgcgcacgtttgcgattgtgctgacgggcgcgtcgatggcggtggccggcatgattatgcagattttgatgcgcaaccgttttgtcgaaccgtcgatggtgggcgcaagccaaagcgcggctttaggtttgctgctgatgaccctgctgctgccggccgcgccgctgccggcgaaaatgtcggttgccgccgttgccgcgctgatcgggatgttggtctttatgctgctgatccgccgcctgccgccgaccgcgcaactgatggtgcctttggtcgggattattttcggcggtgtgattgaggcggtagccacctttatcgcgtatgaaaacgaaatgctgcaaatgctcggcgtgtggcagcagggcgatttttcgagcgtgctgctggggcggtacgagctgctttggattacgggcggtttggcggtgtttgcctatctgattgccgaccggctgacgattttggggctgggcgaaacggtaagcgtgaatttgggtttgaaccggacggcggtgttgtggtcgggtttgattattgtggctttgattacgtcgctggttatcgttacggtcggcaatattccgtttatcgggctggtcgtgccgaacatcatcagccgcctgatgggcgacaggttgcgccaaagcctgcctgcggtggccttgctgggcgcatctttggtgttgctgtgcgacattatcggacgcgtgattgtgtttccgtttgaaattccggtctctacggtttttggtgtattgggtacggctttgtttttgtggcttttgttgaggaaacccgcctatgccgtctga

SEQ ID NO: 2024 - protein, 322 aa, Neisseria meningitidis
MTAKPFSLNLTNLLLLAVLFAVSLSVGVADFRWSDVFSLSDSQQVMFISRLPRTFAIVLTGASMAVAGMIMQILMRNRFVEPSMVGASQSAALGLLLMTLLLPAAPLPAKMSVAAVAALIGMLVFMLLIRRLPPTAQLMVPLVGIIFGGVIEAVATFIAYENEMLQMLGVWQQGDFSSVLLGRYELLWITGGLAVFAYLIADRLTILGLGETVSVNLGLNRTAVLWSGLIIVALITSLVIVTVGNIPFIGLVVPNIISRLMGDRLRQSLPAVALLGASLVLLCDIIGRVIVFPFEIPVSTVFGVLGTALFLWLLLRKPAYAV

SEQ ID NO: 2025 - DNA, 969 bp, Neisseria meningitidis
atgactgccaaacctttttccctcaacctgactaacctcctgctgctggcggtgttgtttgccgtcagcctgtcggtgggcgttgccgatttccgctggtcggatgtgttttcgctgtcggacagccagcaggttatgttcatcagccgcctgccgcgcacgtttgcgattgtgttgacgggcgcgtcgatggcggtggcggggatgattatgcagattctgatgcgtaaccgttttgtcgagccttctatggcgggcgcgggtcagagtgcggctttgggtttgcttctgatgtccctgctgctgcctgccgcgccgctgccggtcaaaatgtcggttgccgccgttgccgcgttaatcgggatgttggtgtttatgatgcttatccgccgcctgccgccgacggcgcaactgatggtgcctttggtcgggattattttcggcggcgtggttgaggcggtggccacctttattgcgtatgaaaacgaaatgctgcaaatgctgggcgtgtggcaacagggcgatttttccggcgtgttgctcggacggtatgaactgttgtgggcaacggggattttggctttgtttgcctatttgattgccgaccagctgacgattttgggtttgggcgaaacggtaagcgtgaacttggggctgaaccggacggcgattctgtggtcggggctgattattgtggctttgattacgtcgctggttatcgttacggtcggcaatattccgtttatcgggctggtcgtgccgaacatcatcagccgcctgataggcgacaggctgcgccaaagcctgcctgcggtggctttgctgggtgcgtctttggttttattgtgcgacattatcggacgagtgattgtgtttccgtttgaaattccggtatcgaccgtcttcggcgtattgggtacggcgttgtttttatggcttttgttaaggaaacctgctcatgccgtctga

SEQ ID NO: 2026 - protein, 322 aa, Neisseria meningitidis
MTAKPFSLNLTNLLLLAVLFAVSLSVGVADFRWSDVFSLSDSQQVMFISRLPRTFAIVLTGASMAVAGMIMQILMRNRFVEPSMAGAGQSAALGLLLMSLLLPAAPLPVKMSVAAVAALIGMLVFMMLIRRLPPTAQLMVPLVGIIFGGVVEAVATFIAYENEMLQMLGVWQQGDFSGVLLGRYELLWATGILALFAYLIADQLTILGLGETVSVNLGLNRTAILWSGLIIVALITSLVIVTVGNIPFIGLVVPNIISRLIGDRLRQSLPAVALLGASLVLLCDIIGRVIVFPFEIPVSTVFGVLGTALFLWLLLRKPAHAV

SEQ ID NO: 2027 - DNA, 852 bp, Neisseria gonorrhoeae
atgatgattttggtgtggctggctttgtttccccccatgttttacggcatgtacaacgtcggcgcacaggcattcggtgccttaacgcccgatttgctgcaacaaagcatcgcccacgacggcaattacgccctcgccaacgctttgggcatcaatatgtcccccgaagcgggcgtgttgggcaaaatgctgttcggcgcgatttacttcctgccgatttacgcgaccgtatttattgtgggcggcttctgggaagtcttgttcgcatccgtacgcaaacacgaaatcaacgaaggtttcttcgttacttcgattctgtttgccttaatcgttccgcccacgctgccgctgtggcaggcggctttgggtatttctttcggcgttgtggttgcgaaagaagtattcggcggtacaggtaaaaacttcatgaaccctgcgctggcaggccgcgccttcctgttcttcgcctaccccgccaacttgagcggcgatgcggtttggacggcggttgacggctattccggcgcaaccgcgctggcgcaatgggcggcacacggtgcagacggcctgaaaaacgccgtaaccggtcaaaccatcacttggatggacgcgtttatcggcaaactgcccggctccatcggcgaagtctccactttggcactcttaatcggcggcgcgtttatcgtgtttgcccgcatcgcttcttggcgcattattgccggcgtgatgatcggtatgattgcgatgtcttcgctgattaacttcatcggttctgacaccaaagctatgtttgctatgcacttggtacatggcacttggtggaaagatgattatcactcactgtacattaaa

SEQ ID NO: 2028 - protein, 284 aa, Neisseria gonorrhoeae
MMILVWLALFPPMFYGMYNVGAQAFGALTPDLLQQSIAHDGNYALANALGINMSPEAGVLGKMLFGAIYFLPIYATVFIVGGFWEVLFASVRKHEINEGFFVTSILFALIVPPTLPLWQAALGISFGVVVAKEVFGGTGKNFMNPALAGRAFLFFAYPANLSGDAVWTAVDGYSGATALAQWAAHGADGLKNAVTGQTITWMDAFIGKLPGSIGEVSTLALLIGGAFIVFARIASWRIIAGVMIGMIAMSSLINFIGSDTKAMFAMHLVHGTWWKDDYHSLYIK

SEQ ID NO: 2029 - DNA, 1068 bp, Neisseria meningitidis
atgatgattttggtgtggctggctttgttccctgccatgttctacggtatgtacaacgtcggcgcgcaggcattcggtgcgttaacgcctgatttgctgcaacaaaacatcgccaacgactggcattacgcctttgccaacgctttgggcatcaatatgtcgtctgaagcgggcgtgtcggacaaaatgctgtttggcgcgatttacttcctgccgatttacgcgactgtatttgttgtgggcggtttctgggaagttttgttcgccaccgtgcgcaaacacgaaatcaacgaaggtttcttcgttacttcgattctgtttgccttaatcgttccgcccacgctgccgctgtggcaggcggctttgggtatttctttcggcgttgtggttgcgaaagaagtattcggcggtacaggtaaaaacttcatgaaccctgcgctggcaggccgtgctttcctgttcttcgcctaccctgccaacttgagcggcgatgcggtttggacggcggttgacggctattccggcgcaaccgcactggcgcaatgggcggcacacggtgcagacggcctgaaaaacgccgtaaccggtcaaaccatcacttggatggacgcgtttatcggcaaactgcccggctccattggcgaagtctccactttggcactcttaatcggcggcgcgtttatcgtgtttgcccgcatcgcttcttggcgcattattgccggcgtgatgatcggtatgattgcgatgtcttcgctgttcaacttcatcggttcggacaccaacgctatgtttgctatgccttggtactggcacttggtggtcggcggcttcgccatcggtatgctgtttatggcgaccgaccctgtttccgcttcctttaccaatgtcggcaaatggtggtacggcgcactgatcggtgtgatgtgcgtattaatccgcgtggtcaatccggcttaccccgaaggcatgatgttggcgattctgtttgccaacctgtttgccccgattttcgactatttcgtcgcacaagcgaacatcaaacgcagaaaggcgcgcagcaatggctaa

SEQ ID NO: 2030 - protein, 355 aa, Neisseria meningitidis
MMILVWLALFPAMFYGMYNVGAQAFGALTPDLLQQNIANDWHYAFANALGINMSSEAGVSDKMLFGAIYFLPIYATVFVVGGFWEVLFATVRKHEINEGFFVTSILFALIVPPTLPLWQAALGISFGVVVAKEVFGGTGKNFMNPALAGRAFLFFAYPANLSGDAVWTAVDGYSGATALAQWAAHGADGLKNAVTGQTITWMDAFIGKLPGSIGEVSTLALLIGGAFIVFARIASWRIIAGVMIGMIAMSSLFNFIGSDTNAMFAMPWYWHLVVGGFAIGMLFMATDPVSASFTNVGKWWYGALIGVMCVLIRVVNPAYPEGMMLAILFANLFAPIFDYFVAQANIKRRKARSNG

SEQ ID NO: 2031 - DNA, 1068 bp, Neisseria meningitidis
atgatgattttggtgtggctggctttgttccctgccatgttctacggtatgtacaacgtcggcgcacaggcattcggtgcgttaacgcccgatttgctgcaacaaagcatcgccaacgactggcattacgcccttgccaacgctttgggcatcaatatgtcgtctgaagcgggcgtgttgggcaaaatgctgttcggcgcgatttacttcctgccgatttacgcgaccgtatttattgtcggcggtttctgggaagttttgttcgccaccgtgcgcaaacatgaaatcaacgaaggtttctttgttacctcgattctgtttgccttaatcgttccgcccacgctgccgctgtggcaggcagctttgggtatttctttcggcgttgtggttgcgaaagaagtattcggcggtacaggtaaaaacttcatgaaccctgcgctggcaggccgtgccttcctgttcttcgcctaccctgccaacttgagcggcgatgcggtttggacggcggttgacggctattccggcgcaaccgcgctggcgcaatgggcggcacacggtgcagacggcctgaaaaacgccataaccggtcaaaccatcacttggatggatgcgtttatcggcaaactgcccggctccatcggcgaagtctccactttggcactcttaatcggcggcgcgtttatcgtgtttgcccgcatcgcttcttggcgcattattgccggcgtgatgatcggtatgattgccatgtcttcgctgttcaacttcatcggttcggacaccaacgctatgtttgctatgccttggtactggcatttggtcgtcggcggcttcgccatcggtatgctgtttatggcgaccgaccccgtttccgcttcctttaccaatgtcggcaaatggtggtacggcgcactgatcggtgtgatgtgcgtattaatccgcgtggtcaatccggcttaccccgaaggcatgatgttggcgattctgtttgccaacctgtttgccccgattttcgactatttcgtcgcacaagcgaacatcaaacgcagaaaggcgcgcagcaatggctaa

SEQ ID NO: 2032 - protein, 355 aa, Neisseria meningitidis
MMILVWLALFPAMFYGMYNVGAQAFGALTPDLLQQSIANDWHYALANALGINMSSEAGVLGKMLFGAIYFLPIYATVFIVGGFWEVLFATVRKHEINEGFFVTSILFALIVPPTLPLWQAALGISFGVVVAKEVFGGTGKNFMNPALAGRAFLFFAYPANLSGDAVWTAVDGYSGATALAQWAAHGADGLKNAITGQTITWMDAFIGKLPGSIGEVSTLALLIGGAFIVFARIASWRIIAGVMIGMIAMSSLFNFIGSDTNAMFAMPWYWHLVVGGFAIGMLFMATDPVSASFTNVGKWWYGALIGVMCVLIRVVNPAYPEGMMLAILFANLFAPIFDYFVAQANIKRRKARSNG

SEQ ID NO: 2033 - DNA, 441 bp, Neisseria gonorrhoeae
atgacccggcgacgggtcggcaagcaaaaccgtattgccatccactccgcgcaataccgaaaaatggtcgtctttgcggtatttcagatacacgatgacggggattttcaactgcgcgagctgttcgaaagacagggcatagcctttcgcctcaaaacccaaatcgggcataatgcgccgcatatcctcaaacgacgcgcgcatctgttccttacccagtttttccaacacttcttcttccgtcagcttttgcccgtaaaaattgttcaaaagcgtcgccaccgaagccgccccgcaggaaaaatccaaatcctgctttacaatattgaaatcccgccgcgctttccaactctgcaatttgatttttccgtaaacaacaggattatcgttaaacatcggtgcagcattcaaacgataagacaagggtctgtaccagattag

SEQ ID NO: 2034 - protein, 146 aa, Neisseria gonorrhoeae
MTRRRVGKQNRIAIHSAQYRKMVVFAVFQIHDDGDFQLRELFERQGIAFRLKTQIGHNAPHILKRRAHLFLTQFFQHFFFRQLLPVKIVQKRRHRSRPAGKIQILLYNIEIPPRFPTLQFDFSVNNRIIVKHRCSIQTIRQGSVPD

SEQ ID NO: 2035 - DNA, 396 bp, Neisseria meningitidis
atgacccagcgacgggtcggcaagcaaaaccgtattgccgtctataccgcgcaataccgagaaatgatcatccttgcggtatttcagatacacgatgacggggatttgcaactgtgcaagctgctcgaaagacagggcatagcctttcgcttcaaaacccaaatcaggcataatgcgccgcatatcctcaaacgacgcgggcatctgctccttatccagtttttttaacacgtcctcttccgtcagcttttgcccgtaaaaattgttcaaaagcgtcaccaccgaagccgccccgcaggaaaaatccaaatcctgctttacaatattgaaatcgcgcctttctttccaactctgcactttgatttttccataagcaacaggattatagtggattaa

SEQ ID NO: 2036 - protein, 130 aa, Neisseria meningitidis
MTQRRVGKQNRIAVYTAQYREMIILAVFQIHDDGDLQLCKLLERQGIAFRFKTQIRHNAPHILKRRGHLLLIQFFHVLFRQLLPVKIVQKRHHRSRPAGKIQILLYNIEIAPFFPTLHFDFSISNRIIVD

SEQ ID NO: 2037 - DNA, 396 bp, Neisseria meningitidis
atgacccagcgacgggtcggcaagcaaaaccgtattgccgtctataccgcgcaataccgagaaatgatcatccttgcggtatttcagatacacgatgacggggatttgcaactgtgcaagctgctcgaaagacagggcatagcctttcgcctcaaaacccaaatcaggcatgatgcgccgcatatcctcaaacgacgcgcgcatctgctccttatccagctttttcaacacgtcctcttccgtcagcttttgcccgtgaaaattgttcaaaagcgtcgccaccgaagccgccccgcaggaaaaatccaaatcctgctttacaatattgaaatcgcgcctttctttccaactctgcactttgatttttccataagcaacaggattatagtggattaa

SEQ ID NO: 2038 - protein, 131 aa, Neisseria meningitidis
MTQRRVGKQNRIAVYTAQYREMIILAVFQIHDDGDLQLCKLLERQGIAFRLKTQIRHDAPHILKRRAHLLLIQLFQHVLFRQLLPVKIVQKRRHRSRPAGKIQILLYNIEIAPFFPTLHFDFSISNRIIVD

SEQ ID NO: 2039 - DNA, 996 bp, Neisseria gonorrhoeae
atgattggcggacagtttatcgtagttggcattgtaggcaaaaacgcacttgcccgctttgttgataatattgtcgtgaatatcggaatagttgacatagttgagcatgatgccctaatcgcggctgccgacggcgatattgtcgaacactttgagccgttcggaaaacatcagcacatagcccatattgttgcccacggaaatattgccgctgacttcgctgtcgttggtgtacatatagtggacggcgaaacgcaggtcgctgaagcggttgtttttataggtgttgtgcgtgctggtattggaaaaaatgccgtcccgccctttggaaatgtcgttgccgacgacctgcgcgccgggcgcgttccaaacggtaacgccattgccgcgctcattcacgcgcaaggtcgcatcgccgacgattttattctcgcgcaccatcgcatcggcagaaccatgaaggtatacgccgaacgaattatcaaaaatattgttgtgttcaaccagggcgcgcggggcggctttttcgagataaataccggcatccattgctggcaggctcataccggaacgggtaacggtcaggttgcggagcgttacgtccggcgcgtgtacggctatggtacgcccgctcttgtccccttcgatggttgcggaacggtcggcaggcccttcaatcgtaatcggtttgtcgatataaagtttggtttgatatacgccggaagccagtttgatcgtatcgcccgcccgggcgcgggcaaaaatttcggcaaggttgtcttgcggggaaacgtggacgacggctgccgatgccgtctgaaaaatgctgccggcggcaagtatcagcacggccttcagccatatacggagcgcggatgtgtgcatagtgtccctctgtttcgttcggtatggccgaacaaaataaagcatcattcaaatgtgcctgtttttatagcgaaaccgcctgaaacggtacggcaagcggtttggctataa

SEQ ID NO: 2040 - protein, 331 aa, Neisseria gonorrhoeae
MIGGQFIVVGIVGKNALARFVDNIVVNIGIVDIVEHDALIAAADGDIVEHFEPFGKHQHIAHIVAHGNIAADFAVVGVHIVDGETQVAEAVVFIGVVRAGIGKNAVPPFGNVVADDLRAGRVPNGNAIAALIHAQGRIADDFILAHHRIGRTMKVYAERIIKNIVVFNQGARGGFFEINTGIHCWQAHTGTGNGQVAERYVRRVYGYGTPALVPFDGCGTVGRPFNRNRFVDIKFGLIYAGSQFDRIARPGAGKNFGKVVLRGNVDDGCRCRLKNAAGGKYQHGLQPYTERGCVHSVPLFRSVWPNKIKHHSNVPVFIAKPPETVRQAVWL

SEQ ID NO: 2041 - DNA, 795 bp, Neisseria meningitidis
atgattggcgaaaagtttatcgtagttggcattataggcaaatacgcacttgcctgccttgttgataatgttgtcgtgaatatcggaatagttgacatagttgagcataatgccctgatcgcggctgccgacggcgatattgtcgaatactttgagccgctcggaaaacatcagcacatagcccatattgttgcccacggaaatattgccgctgatttcgctgtcgttggtgtacatatagtggacggcgaaacgcaaatcgctgaagcggttgtttttgtaggtgttgtgcgtgctggtattggaaaaaatgccgtcccgccctttggaaatgtcgttgccgacgacctgcgcaccgggtgcgttccaaacggtaacgccgttgccgcgctcgttcacgcgcaaagtcgcgtcgccgacgattttattctcgcgcaccatcgcatcggcagaaccatgcagatatacgccgaccgaattatccaaaatattgttgtgttcaatcagggcgcgcggggcagtttcttcgagataaataccggcatccattgcgggcaggctcataccggaacgggtaacggtcaggttgcggagcgttacgtccggcgcgtgtacggctatggtacgcccgctcctgtcgccttcgatggttgcggaacggtcggcaggcccttcaatcgtaatcggtttgtcaatgtgaagtttggttttatatacgccggaagccagtttgagcgtatcgcccgcccgggcgcgggcaaatgcgggataccgatcagcataatcggttcgtga

SEQ ID NO: 2042 - protein, 264 aa, Neisseria meningitidis
MIGEKFIVVGIIGKYALACLVDNVVVNIGIVDIVEHNALIAAADGDIVEYFEPLGKHQHIAHIVAHGNIAADFAVVGVHIVDGETQIAEAVVFVGVVRAGIGKNAVPPFGNVVADDLRTGCVPNGNAVAALVHAQSRVADDFILAHHRIGRTMQIYADRIIQNIVVFNQGARGSFFEINTGIHCGQAHTGTGNGQVAERYVRRVYGYGTPAPVAFDGCGTVGRPFNRNRFVNVKFGFIYAGSQFERIARPGAGKCGIPISIIGS

SEQ ID NO: 2043 - DNA, 798 bp, Neisseria meningitidis
atgattggcggacagtttatcgtagttggcattgtaggcaaaaacgcacttgcccgctttgttgataatgttgtcgtgaatatcggaatagttgacatagttgagcatgatgccttggtcgcggctgccgacggcgatattgtcaaacactttgagccgctcggaaaacatcagcacatagcccatattgttgcccacggaaatattgccgctgatttcgctgtcgttggtgtacatatagtggacggcgaaacgcaaatcgctgaagcggttgtttttataggtgttgtgcgtgctggtattggaaaaaatgccgtcccgccctttggaaatatcgttgccgacgacctgcgcgccgggcgcgttccaaacggtaacgccattgccgcgctcgttcacgcgcaaagtcgcgtcgccgacgattttattctcccgcaccatcgcatcggcagaaccatgcagatagacgccgaccgaattatccaaaatattattgtgttcaatcagggcgcgcggggcagtttcttcgagataaataccggcatccattgcgggcaggctcataccggaacgggtaacggtcaggttgcggagcgttacgtccggcgcgtgtacggctatggtacgcccgctcctgtctccttcgatggttgcagaacggtcggcaggcccttcaatcgtaatcggtttgtcgatgtgaagtttggtttgatatacgccggaagccagtttgagcgtatcgcccgcccgggcgcgggcaaatgcgggataccgatcagcataatcgactcatggtga

SEQ ID NO: 2044 - protein, 265 aa, Neisseria meningitidis
MIGGQFIVVGIVGKNALARFVDNVVVNIGIVDIVEHDALVAAADGDIVKHFEPLGKHQHIAHIVAHGNIAADFAVVGVHIVDGETQIAEAVVFIGVVRAGIGKNAVPPFGNIVADDLRAGRVPNGNAIAALVHAQSRVADDFILPHHRIGRTMQIDADRIIQNIIVFNQGARGSFFEINTGIHCGQAHTGTGNGQVAERYVRRVYGYGTPAPVSFDGCRTVGRPFNRNRFVDVKFGLIYAGSQFERIARPGAGKCGIPISIIDSW

SEQ ID NO: 2045 - DNA, 1035 bp, Neisseria gonorrhoeae
atgagcctgccagcaatggatgccggtatttatctcgaaaaagccgccccgcgcgccctggttgaacacaacaatatttttgataattcgttcggcgtataccttcatggttctgccgatgcgatggtgcgcgagaataaaatcgtcggcgatgcgaccttgcgcgtgaatgagcgcggcaatggcgttaccgtttggaacgcgcccggcgcgcaggtcgtcggcaacgacatttccaaagggcgggacggcattttttccaataccagcacgcacaacacctataaaaacaaccgcttcagcgacctgcgtttcgccgtccactatatgtacaccaacgacagcgaagtcagcggcaatatttccgtgggcaacaatatgggctatgtgctgatgttttccgaacggctcaaagtgttcgacaatatcgccgtcggcagccgcgattagggcatcatgctcaactatgtcaactattccgatattcacgacaatattatcaacaaagcgggcaagtgcgtttttgcctacaatgccaactacgataaactgtccgccaatcattttgaaaactgccaaatcggcatgcactttaccgccgccatcgaaggcacgtccctgcacgacaattcctttatcaacaacggaagccaggtcaaatatgtcagtacgcgctttctcgactggagcgagggcggacacggcaactactggagcgacaacagcccgttcgatttgaacggcgacggcttcggagacagcgcgtaccgtcccgacggcatcatcgaccaaatcatctggcgcgcgcccgtatcgcgcctcttgatgaacagtcccgcaatcagcatcgtcaaatgggcgcaggcgcagtttcccgccgttctgcccggcggcgtggtggacagcaaaccgctgatgaagccttatgcccccaaaattcaaacccgttatcaggcgatgaaggacgagttgctcaaagaagccgaaacgcggcagtcggaacggggcagggcggaaaacggttctttgaactag

SEQ ID NO: 2046 - protein, 343 aa, Neisseria gonorrhoeae
MSLPAMDAGIYLEKAAPRALVEHNNIFDNSFGVYLHGSADAMVRENKIVGDATLRVNERGNGVTVWNAPGAQVVGNDISKGRDGIFSNTSTHNTYKNNRFSDLRFAVHYMYTNDSEVSGNISVGNNMGYVLMFSERLKVFDNIAVGSRDGIMLNYVNYSDIHDNIINKAGKCVFAYNANYDKLSANHFENCQIGMHFTAAIEGTSLHDNSFINNGSQVKYVSTRFLDWSEGGHGNYWSDNSPFDLNGDGFGDSAYRPDGIIDQIIWRAPVSRLLMNSPAISIVKWAQAQFPAVLPGGVVDSKPLMKPYAPKIQTRYQAMKDELLKEAETRQSERGRAENGSLN

SEQ ID NO: 2047 - DNA, 1035 bp, Neisseria meningitidis
atgagcctgcccgcaatggatgccggtatttatctcgaagaaactgccccgcgcgccctgattgaacacaacaatattttggataattcggtcggcgtatatctgcatggttctgccgatgcgatggtgcgcgagaataaaatcgtcggcgacgcgactttgcgcgtgaacgagcgcggcaacggcgttaccgtttggaacgcacccggtgcgcaggtcgtcggcaacgacatttccaaagggcgggacggcattttttccaataccagcacgcacaacacctacaaaaacaaccgcttcagcgatttgcgtttcgccgtccactatatgtacaccaacgacagcgaaatcagcggcaatatttccgtgggcaacaatatgggctatgtgctgatgttttccgagcggctcaaagtattcgacaatatcgccgtcggcagccgcgatcagggcattatgctcaactatgtcaactattccgatattcacgacaacattatcaacaaggcaggcaagtgcgtatttgcctataatgccaactacgataaacttttcgccaatcattttgaaaactgtcaaatcggcatacactttaccgccgccatcgaaggcacgtccttgcatgacaattcctttatcaacaacgaaagccaggtcaaatacgtcagcacgcgctttctcgattggagcgagggcggacacggcaactattggagcgacaacagcgcgttcgatttgaacggcgacggcttcggagacagcgcgtaccgccccaacggcatcatcgaccaaatcatctggcgcgcgcccgtatcgcgccttttgatgaacagtcccgcaatcagcatcgtcaaatgggcgcaggcgcagtttcccgccgttctgcctggcggcgtggtggacagcaaaccgctgatgaagccttatgcccccaaaattcaaacccgttatcaggcgatgaaggacgagctactcaaagaagtcgaaacgcggcagtcggaatggggcagggcggaaaacggttctttgaactag

SEQ ID NO: 2048 - protein, 344 aa, Neisseria meningitidis
MSLPAMDAGIYLEETAPRALIEHNNILDNSVGVYLHGSADAMVRENKIVGDATLRVNERGNGVTVWNAPGAQVVGNDISKGRDGIFSNTSTHNTYKNNRFSDLRFAVHYMYTNDSEISGNISVGNNMGYVLMFSERLKVFDNIAVGSRDQGIMLNYVNYSDIHDNIINKAGKCVFAYNANYDKLFANHFENCQIGIHFTAAIEGTSLHDNSFINNESQVKYVSTRFLDWSEGGHGNYWSDNSAFDLNGDGFGDSAYRPNGIIDQIIWRAPVSRLLMNSPAISIVKWAQAQFPAVLPGGVVDSKPLMKPYAPKIQTRYQAMKDELLKEVETRQSEWGRAENGSLN

SEQ ID NO: 2049 - DNA, 1035 bp, Neisseria meningitidis
atgagcctgcccgcaatggatgccggtatttatctcgaagaaactgccccgcgcgccctgattgaacacaataatattttggataattcggtcggcgtctatctgcatggttctgccgatgcgatggtgcgggagaataaaatcgtcggcgacgcgactttgcgcgtgaacgagcgcggcaatggcgttaccgtttggaacgcgcccggcgcgcaggtcgtcggcaacgatatttccaaagggcgggacggcattttttccaataccagcacgcacaacacctataaaaacaaccgcttcagcgatttgcgtttcgccgtccactatatgtacaccaacgacagcgaaatcagcggcaatatttccgtgggcaacaatatgggctatgtgctgatgttttccgagcggctcaaagtgtttgacaatatcgccgtcggcagccgcgaccaaggcatcatgctcaactatgtcaactattccgatattcacgacaacattatcaacaaagcgggcaagtgcgtttttgcctacaatgccaactacgataaactgtccgccaatcattttgaaaactgccaaatcggcatacactttaccgccgccatcgaaggcacgtccctgcacgacaattcctttatcaacaacgaaagccaggtcaaatacgtcagcacgcgctttctcgactggagcgagggcggacacggcaactattggagcgacaacagcgcgttcgatttgaacggcgacggcttcggagacagcgcgtaccgtcccaacggcatcatcgaccaaatcatctggcgcgcacccgtatcgcgcctcttgatgaacagtcccgcaatcagcatcgtcaaatgggcgcaggcgcaatttcccgccgttttgcctggcggcgtggtggacagcaaaccgctgatgaagccttatgcccccaaaattcaaacccgttatcaggcgatgaaggacgggctgctcaaaaaagtcgaaacgcggcagttggaatggggcagggcggaaaacggttctttgaactag

SEQ ID NO: 2050 - protein, 344 aa, Neisseria meningitidis
MSLPAMDAGIYLEETAPRALIEHNNILDNSVGVYLHGSADAMVRENKIVGDATLRVNERGNGVTVWNAPGAQVVGNDISKGRDGIFSNTSTHNTYKNNRFSDLRFAVHYMYTNDSEISGNISVGNNMGYVLMFSERLKVFDNIAVGSRDQGIMLNYVNYSDIHDNIINKAGKCVFAYNANYDKLSANHFENCQIGIHFTAAIEGTSLHDNSFINNESQVKYVSTRFLDWSEGGHGNYWSDNSAFDLNGDGFGDSAYRPNGIIDQIIWRAPVSRLLMNSPAISIVKWAQAQFPAVLPGGVVDSKPLMKPYAPKIQTRYQAMKDGLLKKVETRQLEWGRAENGSLN

SEQ ID NO: 2051 - DNA, 1191 bp, Neisseria gonorrhoeae
atgattcatataatatcaatattaaagagtatcggtatatcggggatagctatgtcctgtttttcaatccggcgtatgtctgcgtttcgggcgcggataacggcgttttttaccgcctttgtctttttgacggcggcactgcccgcttatgcggagcgtctgcctgattttctggcgaaaatacagccttcggaaatttttccgggtgcggatcgttacggcaagccggaaggcaagcctatggttgcccgcgtttacaaaggcgatgagcagctcggtttggtttatatcacgaccgatgcggtcaatacgcgcggttattcgagcaaaccgatcgatacgctgatggctttggcaaacgacggcacgatagccggggcgaaactggtcgatcatcacgaaccgattatgctgatcggtatcccgcaatcgcgtgtcgataagttcatcgacaaatatatcggtctgaattttattaaaaatccgccgaccccgagcgtggcgccgggcgacatcatcagcggtgcgactgttacactgatggtggttaacgacagcatccagcgttcgtacaaggtcattgccaaccaataccgtctgggttcggacaaggcccttcagacggcatccgcttccgatgttcgggaagccgcgcctgcgtcagaaacccgtccgcgccgtatggcaaatcccgacaagcaggatattttgtcttgggacgaacttttgaaacaaaaggccgtcggccatctgcatatcacgctcgatcaaatcaacaaactgtttgagaaaggcggcaaggccggcgtggccgatcacgccgaacagggcgatcctgacgatacctttattgatttgtatgttgccttggtcagccagccttccatcggtaaaagcctgctgggtgaggacggctgggcgcatctgcaaaaacggctgaaacccgggcagcaggcggttttggttgccggagagggccgttattcttggaaaggttcgggctatgtgcgcggcggtattttcgaccgtatcgagatgattcagggggagaacagcttccgttttaccgatgcccaacacgaacgcgtcgtcgagctgtctgccgccgatgcgccgcgttttaaagaagtttcttggtttaccatccctgaaggcgtagcgtttgacggtgcggagccgtggcggctgtaa

SEQ ID NO: 2052 - protein, 396 aa, Neisseria gonorrhoeae
MIHIISILKSIGISGIAMSCFSIRRMSAFRARITAFFTAFVFLTAALPAYAERLPDFLAKIQPSEIFPGADRYGKPEGKPMVARVYKGDEQLGLVYITTDAVNTRGYSSKPIDTLMALANDGTIAGAKLVDHHEPIMLIGIPQSRVDKFIDKYIGLNFIKNPPTPSVAPGDIISGATVTLMVVNDSIQRSYKVIANQYRLGSDKALQTASASDVREAAPASETRPRRMANPDKQDILSWDELLKQKAVGHLHITLDQINKLFEKGGKAGVADHAEQGDPDDTFIDLYVALVSQPSIGKSLLGEDGWAHLQKRLKPGQQAVLVAGEGRYSWKGSGYVRGGIFDRIEMIQGENSFRFTDAQHERVVELSAADAPRFKEVSWFTIPEGVAFDGAEPWRL

SEQ ID NO: 2053 - DNA, 429 bp, Neisseria meningitidis
atgattcatataatatcaatattaaagagtatcggtatatcggggatagtcatgtcctgtttttcaatcaaacgtatgtccgcgtttcgggcgcggataacggcgttttttgccgcctttgtctttttgacggcggcactgcccgcttatgcggagcgtctgcctgattttctggcgaaaatacagccttcggaaatttttccgggtgcggaccgttacggcaagccggaaggtaagcctatggttgcccgcgtttacaaaggcgatgagcagttgggcttggtctatatcacgaccgatgcggtcaatacgcgcggttattcgagcaaaccgattgatacgctgatggtgttggcaaacgacggcacgatagccggggcgaaactggtcgaccatcacgaaccgattatgctgatcggtatcccgcat

SEQ ID NO: 2054 - protein, 143 aa, Neisseria meningitidis
MIHIISILKSIGISGIVMSCFSIKRMSAFRARITAFFAAFVFLTAALPAYAERLPDFLAKIQPSEIFPGADRYGKPEGKPMVARVYKGDEQLGLVYITTDAVNTRGYSSKPIDTLMVLANDGTIAGAKLVDHHEPIMLIGIPH

SEQ ID NO: 2055 - DNA, 429 bp, Neisseria meningitidis
atgattcatataatatcaatattaaagagtatcggtatatcggggatagtcatgtcctgtttttcaatcaaacgtatgtccgcgtttcgggcgcggataacggcgttttttgccgcctttgtctttttgacggcggcactgcccgcttatgcggagcgtctgcctgattttctggcgaaaatacagccttcggaaattgttccgggtgcggaccgttacagcaagccggaaggtaagcctatggttgcccgcgtttacaaaggcgatgagcagttgggcttggtctatatcacgaccgatgcggtcaatacgcgcggttattcgagcaaaccgattgatacgctgatggcgttggctaaagacggtacgatagccggagcgaaattggttgatcaccatgagtcgattatgctgatcggtatcccgcat

SEQ ID NO: 2056 - protein, 143 aa, Neisseria meningitidis
MIHIISILKSIGISGIVMSCFSIKRMSAFRARITAFFAAFVFLTAALPAYAERLPDFLAKIQPSEIVPGADRYSKPEGKPMVARVYKGDEQLGLVYITTDAVNTRGYSSKPIDTLMALAKDGTIAGAKLVDHHESIMLIGIPH

SEQ ID NO: 2057 - DNA, 1293 bp, Neisseria gonorrhoeae
atgcggtatccgccgcaatcggcggttttgcagaatgccgcgcgttgccttttgcgccgcccgaaatctgcctgccgccgtatttgcccgctatccgcaatatcggcagtccaatatatctttgcggatgtcgttcagcaggaaggctgtggtgtcttcgtgttcctcctgtacgaagacaaaaagtcgggcgatgattttgccgatgaagactttttgcagggcgcaggcgtcggtcagggtgtgttcctgcaggaagctgcggatgtcttcgggcaaagcgtagtcgcgggcaacggcggcaaagcggacatcggtttgcacggcgtcgagcagggtttggtttttgtccaacttaatgcctgcttctttttcttcggcggtggcgcggacgaactggtcgtaaatttcggcataaagcatatcgttcgggccttcaaaaatcgtgaaggggcggatatcgatggcgatattgccggctgggtgtccgcgttcaaaacccttcgcgcccaagagtttttgcaacatttgcgcggcggcgtaagtgtattccgtggcgagggttttgacgatgttcgcctccatcaattgatgggcgacgggcgcgacgggcgaaacggaatggcagacgtagcggtaaaggatttcggaaacctgatggcggcgttggatttcgcggcgttcgtaatcgacgaatctgatatcgttgcggacatatcggttcaggttgtcaaggatgtattccataatgccgtgcgtcatgccgatcagttgcaggcggctgcggataaagatgttttggaacgcgcgcaaaccggcagcgtcgccccgggagagtttcatcacggcggttgcaggcatttcggcatcgatgcggttgacggcgtaacggacggcgcgcaggccttcggatgcgagggtttcgcagcggatgtatgttttggggacgagcagcaggtcgatgactttggcgagtttgccgtttttgcgctctttggcggcaacgaggaggaagtcgctttgcgaattgccctgccagtatttcgcggcgttgacgtaaatggtttgttcgtcggtatattcgtagcaggactgcatttcgcgtgcaatcgccgcgccggaggtttcgggttcggtaacgcccaaacggcggctttcgcctttgaaaatcatgtccaaaccttgtgcgacttgcgcttcgccgccgaactcttgcagaggctgcaacaccagcgcgccttcgatgccggtacgcagcgtaacgggcacgccgtaatgccccgcaatccttag

SEQ ID NO: 2058 - protein, 430 aa, Neisseria gonorrhoeae
MRYPPQSAVLQNAARCLLRRPKSACRRICPLSAISAVQYIFADVVQQEGCGVFVFLLYEDKKSGDDFADEDFLQGAGVGQGVFLQEAADVFGQSVVAGNGGKADIGLHGVEQGLVFVQLNACFFFFGGGADELVVNFGIKHIVRAFKNREGADIDGDIAGWVSAFKTLRAQEFLQHLRGGVSVFRGEGFDDVRLHQLMGDGRDGRNGMADVAVKDFGNLMAALDFAAFVIDESDIVADISVQVVKDVFHNAVRHADQLQAAADKDVLERAQTGSVAPGEFHHGGCRHFGIDAVDGVTDGAQAFGCEGFAADVCFGDEQQVDDFGEFAVFALFGGNEEEVALRIALPVFRGVDVNGLFVGIFVAGLHFACNRRAGGFGFGNAQTAAFAFENHVQTLCDLRFAAELLQRLQHQRAFDAGTQRNGHAVMPRNP

SEQ ID NO: 2059 - DNA, 1221 bp, Neisseria meningitidis
gcctgccgccgtatttgcccgctacccgcaatatcggcagtccaatatatctttgcggatgtcgttcagcaggaaggctgcggtgtcttcgtgtttcgcctgtacgaagacaaagagtcgggcgatgattttgccgataaagactttttgcagggcgcaggcatcggtcagggtgtgttcctgcaggaagctgcggatgtcttcaggcaaagtgtagtcgcgggcgacggcggcaaagcgggcatcggtttgcaggcggtcgagcagggtttggtttttgtccaacttcatgcctgcttctttttcttcggcggtggcgcggacaaactggtcgtaaatttcggcataaagcatatcgttcgggccttcaaaaatcgtgaaggggcggatgtcgatagcgatattgccggcggtgtgtccgcgttcaaaacccttcgcacccaagagtttttgcaacatttgcgcggcggcgtaagtgtattccgtggcgagggttttgacgatgttcgcctccatcagctgatgggcgacgggggcaacaggcgaaacggaatggcagacgtagcggtaaagaatctcggaaacctgatggcggcgccggatttcgcggcgttcgtaatcgacgaatttgatgtcgttgcggacgtatcgttccagattttcaaggatgtattccataatgccgtgcgtcatgccgatcagttgcaggcggctgcggataaagatgttttggaacgcgcgcaaaccggcagcgtcgctctgggagagtttcatcacggcggttgcaggcatttcggcatcgatgcggttgacggcgtaacggacggcgcgcaagccttcggatgcgagggtttcgcagcggatgtatgttttggggacgagcagcaggtcgatgactttggcgagtttgccgtttttgcgctctttggcggcaacgaggaggaagtcgctttgcgagttgccctgccagtatttcgcggcgttgacgtaaatggtttgtccgtcgatatattcgtagtaggactgcatttcgcgtgcaatcgccgcgccggaggtttcgggttcggtaacacccaaaccgccgccctcgcctttgaaaatcatctccaaaccttgcgcgacttgcgcttcatcgccgaactcttgcagtggctgcaacaccagcgcgccttcgatgccggtacgcagcgtaacgggcacgccgtaatgccccgcaatccg

SEQ ID NO: 2060 - protein, 407 aa, Neisseria meningitidis
ACRRICPLPAISAVQYIFADVVQQEGCGVFVFRLYEDKESGDDFADKDFLQGAGIGQGVFLQEAADVFRQSVVAGDGGKAGIGLQAVEQGLVFVQLHACFFFFGGGADKLVVNFGIKHIVRAFKNREGADVDSDIAGGVSAFKTLRTQEFLQHLRGGVSVFRGEGFDDVRLHQLMGDGGNRRNGMADVAVKNLGNLMAAPDFAAFVIDEFDVVADVSFQIFKDVFHNAVRHADQLQAAADKDVLERAQTGSVALGEFHHGGCRHFGIDAVDGVTDGAQAFGCEGFAADVCFGDEQQVDDFGEFAVFALFGGNEEEVALRVALPVFRGVDVNGLSVDIFVVGLHFACNRRAGGFGFGNTQTAALAFENHLQTLRDLRFIAELLQWLQHQRAFDAGTQRNGHAVMPRNP

SEQ ID NO: 2061 - DNA, 1221 bp, Neisseria meningitidis
gcctgccgccgtatttgcccgctatccgcaatatcggcagtccaatatgtctttgcggatgtcgttcagcaggaaggctgcggtgtcttcgtgttccgcctgtacgaagacaaagagtcgggcgatgattttgccgataaagactttttgcagggcgcaggcatcggtcagggtgtgttcctgcaggaagctgcggatgtcttcgggcaaagtgtagtcgcgggcgacggcggcaaagcgggcatcggtttgcaggcggtcgagcagggtttggtttttgtccaacttcatgcctgcttctttttcttcggcggtggcgcggacaaactggtcgtaaatttcggcataaagcatatcgttcgggccttcaaaaatcgtgaaggggcggatgtcgatagcgatattgccggcggtgtgtccgcgttcaaaacccttcgcgcccaagagtttttgcaacatttgcgcggcggcgtaagtgtattccgtggcgagggttttgacgatgttcgcctccatcagttgatgggcgacgggtgcaacgggcgaaacggaatggcagacgtagcggtaaagaatctcggaaacctgatggcggcgccggatttcgcggcgttcgtaatcgacgaatctgatgtcgttgcggacgtatcgttccaggttttcaagggtgtattccataatgccgtgcgtcatgccgatcagttgcaggcggctgcggataaagatgttttggaacgcgcgcaaaccggcagcgtcgctctgggagagtttcatcacggcggttgcaggcatttcggcatcgatgcggttgacggcgtaacggacggcgcgcaagccttcggatgcgagggtttcgcagcggatgtatgttttggggacgagcagcaggtcgatgactttggcgagtttgccgtttttgcgctctttggcggcaacgaggaggaagtcgctttgcgagttgccctgccagtatttcgcggcgttgacgtaaatggtttgtccgtcggtatattcgtagtaagactgcatttctcgggcaatcgccgcgccggaggtttcgggttcggtaacgcctaaaccgccgccctcgcctttgaaaaccatgtccaaaccctgtgcgatttgcgcttcatcgccgaactcttgcagtggctgcaacaccagcgcgccttcgatgccggtacgcagcgtaacgggcacgccgtaatgccccgcaatccg

SEQ ID NO: 2062 - protein, 406 aa, Neisseria meningitidis
ACRRICPLSAISAVQYVFADVVQQEGCGVFVFRLYEDKESGDDFADKDFLQGAGIGQGVFLQEAADVFGQSVVAGDGGKAGIGLQAVEQGLVFVQLHACFFFFGGGADKLVVNFGIKHIVRAFKNREGADVDSDIAGGVSAFKTLRAQEFLQHLRGGVSVFRGEGFDDVRLHQLMGDGCNGRNGMADVAVKNLGNLMAAPDFAAFVIDESDVVADVSFQVFKGVFHNAVRHADQLQAAADKDVLERAQTGSVALGEFHHGGCRHFGIDAVDGVTDGAQAFGCEGFAADVCFGDEQQVDDFGEFAVFALFGGNEEEVALRVALPVFRGVDVNGLSVGIFVVRLHFSGNRRAGGFGFGNATAALAFENHVQTLCDLRFIAELLQWLQHQRAFDAGTQRNGHAVMPRNP

SEQ ID NO: 2063 - DNA, 411 bp, Neisseria gonorrhoeae
  misc_feature (57)..(57): n is a, c, g, or t
atggtgttgcctttgatgttgttggcgacaatcaggtcggctacgctgacgttgtancgtttggcaatgttgaacagggtgtcgccttctacaacgcggtggatgctggcatggagcggggaggtttcggcttcgccgtcggcagctttggctacgcgcgtttccaaacgtgcccggcgtttgccgtcggcggcaacggtatgttgcggagatgaggaaatgttgtgttcggcaactgtgtcaggcgtgccgatgacggcggagatggtttcttcagcctgccggcgcaggttgtttcgggcaacaagctgcatgagttcgtctgccgcctgcatgtcgtttggggggatgacctgcgcgagtgttgcggtttgggtttcagacggcatggcagtctgtttttcggtttga

SEQ ID NO: 2064 - protein, 136 aa, Neisseria gonorrhoeae
  misc_feature (19)..(19): Xaa can be any naturally occurring amino acid
MVLPLMLLATIRSATLTLXRLAMLNRVSPSTTRWMLAWSGEVSASPSAALATRVSKRARRLPSAATVCCGDEEMLCSATVSGVPMTAEMVSSACRRRLFRATSCMSSSAACMSFGGMTCASVAVWVSDGMAVCFSV

SEQ ID NO: 2065 - DNA, 411 bp, Neisseria meningitidis
atggtgttgcctttgatgttgttggcgacaatcaggtcggctacactgacgttgtagcgtttggcaatgttgaacagggtgtcgccttctacaacgcggtggatgctggcatggagcggggagatttcggcttcgccgtcggcagctttggctacgcgcgtttccaaacgtacccggcgtttgccgtcggcggcagcggtatgttgcggagatgcggaaattttgtgttcggcaactgtgtcaggcgtgccgatgacggcggagatggtttcttcagcctgtcggcgcaggttgtttcgggcaacaagctgcatgagttcgtctgccgcctgcatgtcgttttgggggatgatctgcgcgagtgttgcggtttgggtttcagacggcatggcggtctgtttttcggtttga

SEQ ID NO: 2066 - protein, 135 aa, Neisseria meningitidis
MVLPLMLLATIRSATLTLRLAMLNRVSPSTTRWMLAWSGEISASPSAALATRVSKRTRRLPSAAAVCCGDAEILCSATVSGVPMTAEMVSSACRRRLFRATSCMSSSAACMSFWGMICASVAVWVSDGMAVCFSV

SEQ ID NO: 2067 - DNA, 411 bp, Neisseria meningitidis
atggtgttgcctttgatgttgttggcgacaatcaggtcggctacactgacgttgtagcgtttggcaatgttgaacagggtgtcgccttctacaacgcggtggatgctggcatggagcggggagatttcggcttcgccgtcggcagctttggctacgcgcgtttccaaacgtacccggcgtttgccgtcggcggcaacggtatgttgcggagatgaggaaatgttgtgttcggcaactgtgtcaggcgtgccgatgacggcagagatggtttcttcagcctgtcggcgcaggttgtttcgggcaacaagctgcatgagttcgtctgccgcctgcatgtcgttttgggggacgatctgcgcgagtgttgcggtttgggtttcagacggcatggcggtctgtttttcggtttga

SEQ ID NO: 2068 - protein, 135 aa, Neisseria meningitidis
MVLPLMLLATIRSATLTLRLAMLNRVSPSTTRWMLAWSGEISASPSAALATRVSKRTRRLPSAATVCCGDEEMLCSATVSGVPMTAEMVSSACRRRLFRATSCMSSSAACMSFWGTICASVAVWVSDGMAVCFSV

SEQ ID NO: 2069 - DNA, 1554 bp, Neisseria meningitidis
atgccgtctgaaaggccggcggattgttgcccggtgcactttgtggtaaagtttagaaaattaactctaaactgtggcaggcggtttgaccggccgccgattaatgggaaccgacagaggaagccgatgatacacaccgaaccgagcgcgcagccgtcaaccatggacacggctgcttttttaaagcacatcgaatccgcattcccccgcattttttcagacggcatcgacctgatgcgatacctgcccgaagacaaatggcttgccttgaagcaggcgggtttgctgttgcccttcctcgacaaaaaacacggcgggcgcaagggcagtcagtttgaaatccaagaagtcctaaggattgcggggcattacggcgtgcccgttacgctgcgtaccggcatcgaaggcgcgctggtgttgcagcctctgcaagagttcggcggcgaagcgcaagtcgcacaaggtttggacatgattttcaaaggcgaaagccgccgtttgggcgttaccgaacccgaaacctccggcgcggcgattgcacgcgaaatgcagtcctgctacgaatataccgacgaacaaaccatttacgtcaacgccgcgaaatactggcagggcaattcgcaaagcgacttcctcctcgttgccgccaaagagcgcaaaaacggcaaactcgccaaagtcatcgacctgctgctcgtccccaaaacatacatccgctgcgaaaccctcgcatccgaaggcctgcgcgccgtccgttacgccgtcaaccgcatcgatgccgaaatgcctgcaaccgccgtgatgaaactctcccggggcgacgctgccggtttgcgcgcgttccaaaacatctttatccgcagccgcctgcaactgatcggcatgacgcacggcattatggaatacatccttgacaacctgaaccgatatgtccgcaacgatatcagattcgtcgattacgaacgccgcgaaatccaacgccgccatcaggtttccgaaatcctttaccgctacgtctgccattccgtttcgcccgtcgcgcccgtcgcccatcaattgatggaggcgaacatcgtcaaaaccctcgccacggaatacacttacgccgccgcgcaaatgttgcaaaaactcttgggcgcgaagggttttgaacgcggacacccagccggcaatatcgccatcgatatccgccccttcacgatttttgaaggcccgaacgatatgctttatgccgaaatttacgaccagttcgtccgcgccaccgccgaagaaaaagaagcaggcattaagttggacaaaaaccaaaccctgctcgacgccgtgcaaaccgatgtccgctttgccgccgttgcccgcgactacgctttgcccgaagacatccgcagcttcctgcaggaacacaccctgaccgacgcctgcgccctgcaaaaagtcttcatcggcaaaatcatcgcccgactttttgtcttcgtacaggaggaacacgaagacaccacagccttcctgctgaacgacatccgcaaagatatattggactgccgatattgcggatag

SEQ ID NO: 2070 - protein, 517 aa, Neisseria meningitidis
MPSERPADCCPVHFVVKFRKLTLNCGRRFDRPPINGNRQRKPMIHTEPSAQPSTMDTAAFLKHIESAFPRIFSDGIDLMRYLPEDKWLALKQAGLLLPFLDKKHGGRKGSQFEIQEVLRIAGHYGVPVTLRTGIEGALVLQPLQEFGGEAQVAQGLDMIFKGESRRLGVTEPETSGAAIAREMQSCYEYTDEQTIYVNAAKYWQGNSQSDFLLVAAKERKNGKLAKVIDLLLVPKTYIRCETLASEGLRAVRYAVNRIDAEMPATAVMKLSRGDAAGLRAFQNIFIRSRLQLIGMTHGIMEYILDNLNRYVRNDIRFVDYERREIQRRHQVSEILYRYVCHSVSPVAPVAHQLMEANIVKTLATEYTYAAAQMLQKLLGAKGFERGHPAGNIAIDIRPFTIFEGPNDMLYAEIYDQFVRATAEEKEAGIKLDKNQTLLDAVQTDVRFAAVARDYALPEDIRSFLQEHTLTDACALQKVFIGKIIARLFVFVQEEHEDTTAFLLNDIRKDILDCRYCG

SEQ ID NO: 2071 - DNA, 1554 bp, Neisseria meningitidis
atgccgtctgaaaggtcggcggattgttgcccggcgcactttgtggtaaagtttagaaaatcaactctaaactgtggcaggcggtttgaccggccgccgattaatgggaaccgacagaggaagccgatgatacacaccgaaccgagcgcgcagccgtcaactatggacacggctgcttttttaaagcacatcgaatccgcattccgccgcattttttcagacggtatcgacctgatgcgatacctgcccgaagacaaatggcttgccttgaagcaggcgggtttgctgttgcccttcctcgacaaaaaatacggcgggcgcaagggcagccagtttgaaatccaagaagtcctgcggattgcggggcattacggcgtgcccgttacgctgcgtaccggcatcgaaggcgcgctggtgttgcagccactgcaagagttcggcgatgaagcgcaagtcgcgcaaggtttggagatgattttcaaaggcgagggcggcggtttgggtgttaccgaacccgaaacctccggcgcggcgattgcacgcgaaatgcagtcctactacgaatatatcgacggacaaaccatttacgtcaacgccgcgaaatactggcagggcaactcgcaaagcgacttcctcctcgttgccgccaaagagcgcaaaaacggcaaactcgccaaagtcatcgacctgctgctcgtccccaaaacatacatccgctgcgaaaccctcgcatccgaaggcttgcgcgccgtccgttacgccgtcaaccgcatcgatgccgaaatgcctgcaaccgccgtgatgaaactctcccagagcgacgctgccggtttgcgcgcgttccaaaacatctttatccgcagccgcctgcaactgatcggcatgacgcacggcattatggaatacatccttgaaaatctggaacgatacgtccgcaacgacatcaaattcgtcgattacgaacgccgcgaaatccggcgccgccatcaggtttccgagattctttaccgctacgtctgccattccgtttcgcctgttgcccccgtcgcccatcagctgatggaggcgaacatcgtcaaaaccctcgccacggaatacacttacgccgccgcgcaaatgttgcaaaaactcttgggtgcgaagggttttgaacgcggacacaccgccggcaatatcgctatcgacatccgccccttcacgatttttgaaggcccgaacgatatgctttatgccgaaatttacgaccagtttgtccgcgccaccgccgaagaaaaagaagcaggcatgaagttggacaaaaaccaaaccctgctcgaccgcctgcaaaccgatgcccgctttgccgccgtcgcccgcgactacactttgcctgaagacatccgcagcttcctgcaggaacacaccctgaccgatgcctgcgccctgcaaaaagtctttatcggcaaaatcatcgcccgactctttgtcttcgtacaggcgaaacacgaagacaccgcagccttcctgctgaacgacatccgcaaagatatattggactgccgatattgcgggtag

SEQ ID NO: 2072 - protein, 517 aa, Neisseria meningitidis
MPSERSADCCPAHFVVKFRKSTLNCGRRFDRPPINGNRQRKPMIHTEPSAQPSTMDTAAFLKHIESAFRRIFSDGIDLMRYLPEDKWLALKQAGLLLPFLDKKYGGRKGSQFEIQEVLRIAGHYGVPVTLRTGIEGALVLQPLQEFGDEAQVAQGLEMIFKGEGGGLGVTEPETSGAAIAREMQSYYEYIDGQTIYVNAAKYWQGNSQSDFLLVAAKERKNGKLAKVIDLLLVPKTYIRCETLASEGLRAVRYAVNRIDAEMPATAVMKLSQSDAAGLRAFQNIFIRSRLQLIGMTHGIMEYILENLERYVRNDIKFVDYERREIRRRHQVSEILYRYVCHSVSPVAPVAHQLMEANIVKTLATEYTYAAAQMLQKLLGAKGFERGHTAGNIAIDIRPFTIFEGPNDMLYAEIYDQFVRATAEEKEAGMKLDKNQTLLDRLQTDARFAAVARDYTLPEDIRSFLQEHTLTDACALQKVFIGKIIARLFVFVQAKHEDTAAFLLNDIRKDILDCRYCG

SEQ ID NO: 2073 - DNA, 1554 bp, Neisseria meningitidis
  misc_feature (386)..(402): n is a, c, g, or t
atgccgtctgaaaggtcggcggattgttgcccggcgcactttgtggtaaagtttagaaaatcaactctaaactgtggcaggcggtttgaccggccgccgattaatgggaaccgacagaggaagccgatgatacacaccgaaccgagcgcgcagccgtcaactatggacacggctgcttttttaaagcacatcgaatccgcattccgccgcatttttgcagacggtatcgacctgatgcgatacctgcccgaagacaaatggcttgccttgaagcaggcgggtttgctgttgcccttcctcgacaaaaaatacggcgggcgcaagggcagccagtttgaaattcaggaagtcttgcggattgcggggcattacggcgtgcccgttannnnnnnnnnnnnnnnngaaggcgcgctggtgttgcagccactgcaagagttcggcgatgaagcgcaaatcgcacagggtttggacatggttttcaaaggcgagggcggcggtttaggcgttaccgaacccgaaacctccggcgcggcgattgcccgagaaatgcagtcttactacgaatataccgacggacaaaccatttacgtcaacgccgcgaaatactggcagggcaactcgcaaagcgacttcctcctcgttgccgccaaagagcgcaaaaacggcaaactcgccaaagtcatcgacctgctgctcgtccccaaaacatacatccgctgcgaaaccctcgcatccgaaggcttgcgcgccgtccgttacgccgtcaaccgcatcgatgccgaaatgcctgcaaccgccgtgatgaaactctcccagagcgacgctgccggtttgcgcgcgttccaaaacatctttatccgcagccgcctgcaactgatcggcatgacgcacggcattatggaatacacccttgaaaacctggaacgatacgtccgcaacgacatcagattcgtcgattacgaacgccgcgaaatccggcgccgccatcaggtttccgagattctttaccgctacgtctgccattccgtttcgcccgttgcacccgtcgcccatcaactgatggaggcgaacatcgtcaaaaccctcgccacggaatacacttacgccgccgcgcaaatgttgcaaaaactcttgggcgcgaagggttttgaacgcggacacaccgccggcaatatcgctatcgacatccgccccttcacgatttttgaaggcccgaacgatatgctttatgccgaaatttacgaccagtttgtccgcgccaccgccgaagaaaaagaagcaggcatgaagttggacaaaaaccaaaccctgctcgaccgcctgcaaaccgatgcccgctttgccgccgtcgcccgcgactacactttgcccgaagacatccgcagcttcctgcaggaacacaccctgaccgatgcctgcgccctgcaaaaagtctttatcggcaaaatcatcgcccgactctttgtcttcgtacaggcggaacacgaagacaccgcagccttcctgctgaacgacatccgcaaagacatattggactgccgatattgcggatag

SEQ ID NO: 2074 - protein, 517 aa, Neisseria meningitidis
  misc_feature (129)..(134): Xaa can be any naturally occurring amino acid
MPSERSADCCPAHFVVKFRKSTLNCGRRFDRPPINGNRQRKPMIHTEPSAQPSTMDTAAFLKHIESAFRRIFADGIDLMRYLPEDKWLALKQAGLLLPFLDKKYGGRKGSQFEIQEVLRIAGHYGVPVXXXXXXEGALVLQPLQEFGDEAQIAQGLDMVFKGEGGGLGVTEPETSGAAIAREMQSYYEYTDGQTIYVNAAKYWQGNSQSDFLLVAAKERKNGKLAKVIDLLLVPKTYIRCETLASEGLRAVRYAVNRIDAEMPATAVMKLSQSDAAGLRAFQNIFIRSRLQLIGMTHGIMEYTLENLERYVRNDIRFVDYERREIRRRHQVSEILYRYVCHSVSPVAPVAHQLMEANIVKTLATEYTYAAAQMLQKLLGAKGFERGHTAGNIAIDIRPFTIFEGPNDMLYAEIYDQFVRATAEEKEAGMKLDKNQTLLDRLQTDARFAAVARDYTLPEDIRSFLQEHTLTDACALQKVFIGKIIARLFVFVQAEHEDTAAFLLNDIRKDILDCRYCG

SEQ ID NO: 2075 - DNA, 861 bp, Neisseria gonorrhoeae
atgatgatggtgttggcgttggggatgtcgatgccggtttcgatgatggtggaacagagcaacacattgaatctttgctgcaaaaagtcgcgcatgacttgttccagctcgcgctcacgcagttgtccgtgcgccacgccgatacgggcttcgggcagcagggtttccagccgctcgcgcatattctcaatcgtatctacttcattgtgcaggaaaaatacctgtcctccgcgtttgagttcgcgcaacacggcttcgcgcacgctgccttcgctgaacggtttgacaaaggttttcacggcgaggcggcggctcggtgcagtggtaatcagcgagaagtcgcgcagaccttcgagcgccatgctgagggtgcgcggaatcggcgtggcggtcatggttaggatgtcgacattggcgcgcaggcgtttgagctgctctttctgtcgcacgccgaagcggtgttcttcatcgataatcaataaacctaagtttttgaattttatgtcgtcctgcaccaatttgtgcgtaccgataacgatatcgacagtaccgtccgccatgccttcgagcgtggctttggtggctttgctgttgttgaaacgcgaaaggctggcgactttcacggggaaatcggcgaaacggtcggcgaagttttgcgcgtgctgctcgaccagaagcgtggtcggggcgagtacggcgacctgtttgccgcccatcaccgccacaaacgcggcgcgaagggcgacttcggttttgccgaaaccgacatcgccgcacacaagtcggtccatcggcttcgcctgcgtcaaatctttaatcacggcggcgatggcggcggcctggtcttcggtttcctcgtag

SEQ ID NO: 2076 - protein, 286 aa, Neisseria gonorrhoeae
MMMVLALGMSMPVSMMVEQSNTLNLCCKKSRMTCSSSRSRSCPCATPIRASGSRVSSRSRIFSIVSTSLCRKNTCPPRLSSRNTASRTLPSLNGLTKVFTARRRLGAVVISEKSRRPSSAMLRVRGIGVAVMVRMSTLARRRLSCSFCRTPKRCSSSIINKPKFLNFMSSCTNLCVPITISTVPSAMPSSVALVALLLLKRERLATFTGKSAKRSAKFCACCSTRSVVGASTATCLPPITATNAARRATSVLPKPTSPHTSRSIGFACVKSLITAAMAAAWSSVSS

SEQ ID NO: 2077 - DNA, 861 bp, Neisseria meningitidis
atgatgatggtgttggcgttggggatatcgataccggtttcgatgatggtggaacagagcaacacgttaaatcgttgctgcaaaaagtcgcgcatgacttgttccagctcgcgctcgcgcagttgtccgtgcgccacgccgatgcgggcttcgggcagcagggtttccagccgctcgcgcatattttcaatcgtatctacttcattgtgcaggaaaaatacctgtcctccgcgtttgagttcgcgcaacacggcttcgcgcacgctgccttcgctaaagggtttgacaaaggttttgacggcgaggcggcggctgggcgcggtggtaatcagcgagaagtcgcgcagtccttccaacgccatacttaaagtacgcggaatcggcgtggcggtcatggtaaggatatcaacattggcgcgcaggcgtttgagctgctctttctgacgcacgccgaagcggtgttcttcgtcgataatcactaaacctaagtttttgaatttgatgtcgtcctgcaccagtttgtgcgtaccgataacaatatcgaccgtgccgtctgccatgccttccagcgcggctttggtggctttgctgttgttgaaacgcgaaaggctggcgactttcacggggaaatcggcgaaacggtcggcgaagttttgcgcgtgctgctcgaccaaaagcgtggtcggagcaagtacggcgacctgtttgccgcccatcaccgccacaaacgcggcgcgcagggcgacttcggttttgccgaagccgacatcgccgcacacaaggcgatccatcggcttcgcttgcgtcaaatctttaatcacggcggcgatggcggcggcctggtcttcggtttcctcgtag

SEQ ID NO: 2078 - protein, 285 aa, Neisseria meningitidis
MMMVLALGISIPVSMMVEQSNTLNRCCKKSRMTCSSSRSRSCPCATPMRASGSRVSSRSRIFSIVSTSLCRKNTCPPRLSSRNTASRTLPSLKGLTKVLTARRRLGAVVISEKSRSPSNAILKVRGIGVAVMVRISTLARRRLSCSFRTPKRCSSSIITKPKFLNLMSSCTSLCVPITISTVPSAMPSSAALVALLLLKRERLATFTGKSAKRSAKFCACCSTKSVVGASTATCLPPITATNAARRATSVLPKPTSPHTRRSIGFACVKSLITAAMAAAWSSVSS

SEQ ID NO: 2079 - DNA, 861 bp, Neisseria meningitidis
atgatgatggtgttggcgttgggaatgtcgataccggtttcgatgatggtggaacagagcaacacgttaaatcgttgctgcaaaaagtcgcgcatgacttgttccagctcgcgctcgcgcagttgtccgtgcgccacgccgatgcgggcttcgggcagcagggtttccagccgctcacgcatgttttcgatggtatccacttcattgtgcaggaaaaatacttgcccgccgcgtttgagttcgcgcaatacggcttcgcgcacgctgccttcgctgaacggtttgacaaaggttttgacggcgaggcggcggctgggcgcagtggtaatcagcgagaagtcgcgcagtccttccagcgccatacttaaagtacgcggaatcggcgtagcggtcatggtaaggatgtcgacattggcgcgcaggcgtttgagctgctctttctgacgcacgccgaagcggtgttcttcgtcgataatcactaaacctacgtttttgaattttatgtcgtcctgcaccagtttgtgcgtaccgataacaatatcgaccgtgccgtccgccatgccttccagcgcggctttggtggctttgctgttgttgaaacgcgaaaggctggcgactttcacggggaaatcggcgaagcggtcggcaaaattttgcgcgtgctgctcgaccagaagcgtggtcggtgcgagtacggcaacttgtttgccacccattaccgccacaaacgcggcgcgcagggcgacttcggttttgccgaaaccgacatcgccgcacacgaggcggtccatcggcttcgcctgcgtcaaatctttaatcacggcggcgatggcggctgcctggtcttcggtttcttcgtag

SEQ ID NO: 2080 - protein, 285 aa, Neisseria meningitidis
MMMVLALGMSIPVSMMVEQSNTLNRCCKKSRMTCSSSRSRSCPCATPMRASGSRVSSRSRMFSMVSTSLCRKNTCPPRLSSRNTASRTLPSLNGLTKVLTARRRLGAVVISEKSRSPSSAILKVRGIGVAVMVRMSTLARRRLSCSFRTPKRCSSSIITKPTFLNFMSSCTSLCVPITISTVPSAMPSSAALVALLLLKRERLATFTGKSAKRSAKFCACCSTRSVVGASTATCLPPITATNAARRATSVLPKPTSPHTRRSIGFACVKSLITAAMAAAWSSVSS

SEQ ID NO: 2081 - DNA, 312 bp, Neisseria gonorrhoeae
atgcaaaggctcgccgcagacggcatccaaatcttttttgtaggtgtcgatgggcagtttgccttgcgaataaacggtttggttaaagagcgtgcacgctccgtattctttggcaaggtttgccgatgctttgagcaggtaatactgtatggcttcaaaggtacggtgggtcagaccgagcgcggaaccgtcgctgtagcggacaccgtttttcgccagatagtaggcgtagttgatgacaccgatgccgagcgaacggcggtccatagtagaggtacgcgcggcttctaccggatatccctgataatctaa

SEQ ID NO: 2082 - protein, 103 aa, Neisseria gonorrhoeae
MQRLAADGIQIFFVGVDGQFALRINGLVKERARSVFFGKVCRCFEQVILYGFKGTVGQTERGTVAVADTVFRQIVGVVDDTDAERTAVHSRGTRGFYRISLII

SEQ ID NO: 2083 - DNA, 312 bp, Neisseria meningitidis
atgcaaaggctcgccgcagacggcatccaaatcttttttgtaagtgtcgatgggcagtttgccttgcgaataaacggtttggttaaagagcgtgcacgcaccgtattctttggcaaggtttgccgatgctttgagcaggtaatactgtatggcttcaaaggtacggtgggtcagaccgagcgcggaaccgtcgctgtagcggacaccgtttttcgccagataataagcatagttaatcacgccgatgccgagcgaacggcggcccatagtagaggtacgcgcggcttctaccggatatccctgataatctaa

SEQ ID NO: 2084 - protein, 103 aa, Neisseria meningitidis
MQRLAADGIQIFFVSVDGQFALRINGLVKERARTVFFGKVCRCFEQVILYGFKGTVGQTERGTVAVADTVFRQIISIVNHADAERTAAHSRGTRGFYRISLII

SEQ ID NO: 2085 - DNA, 312 bp, Neisseria meningitidis
gtgcaaaggctcgttacacacagcgtccaagtcttttttgtaggtgtcgatgggcagtttgccttgcgaataaacggtttggttaaagagcgtgcacgcaccgtattctttggcaaggtttgccgatgctttgagcaggtaatactgtatggcttcaaaggtacggtgggtcagaccgagcgcggagccgtcgctgtagcggacaccgtttttcgccaaataatacgcatagttgatcacgccgataccgagcgaacggcggcccatagtggaggtacgcgcggcttctaccggatatccctgataatctaa

SEQ ID NO: 2086 - protein, 103 aa, Neisseria meningitidis
VQRLVTHSVQVFFVGVDGQFALRINGLVKERARTVFFGKVCRCFEQVILYGFKGTVGQTERGAVAVADTVFRQIIRIVDHADTERTAAHSGGTRGFYRISLII

SEQ ID NO: 2087 - DNA, 636 bp, Neisseria gonorrhoeae
atgaacaggcgcaacgcgcggatcgaacgggctgtgcgtattgcagtgatcgacgttttgaatgtagatgcgcccggtcccggcacgctcctgcatcagcgtggaaaacaggtcggcagccggaatgatacgcttgcgtatgttcgggtcttgctcgtatttcgtatagagccgctcaaattcgtcttggtcggcaaaaaacgcttcgtacaaccccgaaacctcgttgggcgaaaacagcgtaatgttgccgcccttaatcaggcgggtgtacagcaggcggttgatttgcacgccataatcaagctggcggatacggttgtcttccacgccccggttgtttttcaacaccagcaggctttcggcttcaatatgccacaaggggtagaacaaggttgccgcgccgccgcgcacgccaccttgcgaacaagatttgaccgccgcctgaaacatcttaaagaagggaatgcagccggtatgccgggcttcaccgccccggatttcgctgtccagcccgcggatacgtccggcattgatgccgatgcccgcgcgttgggaaacgtatttcacaatcgcgctggtagtggcattgatggaatccaaactatcgtcgcattcaatcagcacacagcttga

SEQ ID NO: 2088 - protein, 211 aa, Neisseria gonorrhoeae
MNRRNARIERAVRIAVIDVLNVDAPGPGTLLHQRGKQVGSRNDTLAYVRVLLVFRIEPLKFVLVGKKRFVQPRNLVGRKQRNVAALNQAGVQQAVDLHAIIKLADTVVFHAPVVFQHQQAFGFNMPQGVEQGCRAAAHATLRTRFDRRLKHLKEGNAAGMPGFTAPDFAVQPADTSGIDADARALGNVFHNRAGSGIDGIQTIVAFNQHTA

SEQ ID NO: 2089 - DNA, 636 bp, Neisseria meningitidis
atgaacaggcgcgacgcgcggatcgaacgggctgtgcgtattgcagtgatcgacgttttgaatgtagatgcgcccggttccggcacgctcctgcatcagcgtggaaaacaggtcggcagccggaatgatgcgcttgcggatatcagggtcttgctcgtatttcgtatagagccgctcaaattcgtcttggtcggcaaaaaacgcttcgtacaatcccggaacctcgttgggcgaaaacagcgtaatgttgccgcccttaatcaggcgggtgtacagcaggcggttgatttgcacgccgtaatcaagctgacggatacggttgtcttccacaccgcggttgtttttcaacaccagcaggctttcggcttcgatatgccacaaggggtagaacaaggttgccgcgccgccgcgcacgccgccttgcgaacaggatttgaccgccgcctgaaacattttaaagaagggaatgcagccggtatgccgcgcttcgccgccccggatttcgctgtccaaaccgcggatacgtccggcattgatgccgatgcccgcacgctgggaaacgtatttcacaatcgcgctggtagtggcattgatggaatccaaactatcgtcgcattcaatcagcacacagcttga

SEQ ID NO: 2090 - protein, 211 aa, Neisseria meningitidis
MNRRDARIERAVRIAVIDVLNVDAPGSGTLLHQRGKQVGSRNDALADIRVLLVFRIEPLKFVLVGKKRFVQSRNLVGRKQRNVAALNQAGVQQAVDLHAVIKLTDTVVFHTAVVFQHQQAFGFDMPQGVEQGCRAAAHAALRTGFDRRLKHFKEGNAAGMPRFAAPDFAVQTADTSGIDADARTLGNVFHNRAGSGIDGIQTIVAFNQHTA

SEQ ID NO: 2091 - DNA, 636 bp, Neisseria meningitidis
atgaacaggcgcaacgcgcggatcgaacgggctgtgcgtattgcagtgatcgacgttttgaatgtagatgcgcccggttccggcacgctcctgcatcagcgtggaaaacaggtcggcagccggaatgatgcgcttgcggatatcagggtcttgctcgtatttcgtatagagccgctcaaattcgtcttggtcggcaaaaaacgcttcgtacaatcccggaacctcgttgggcgaaaacagcgtaatgttgccgcccttaatcaggcgggtgtacagcaggcggttgatttgcacgccgtaatcaagctgacggatacggttgtcttccacgccccggttgtttttcaacaccagcaggctttcggcttcgatatgccacaaggggtagaacaaggttgccgcgccgccgcgcacgccaccttgcgaacaggatttgactgccgcctgaaacattttaaagaagggaatgcagccggtatgccgtgcttcgccgccccggatttcgctgtccagtccgcggatacgtccggcattgatgccgatgcccgcacgctgggaaacgtatttcacaatcgcgctggtagtggcgttgatggaatccaggctgtcgtcgcattcgatcaatacgcagcttga

SEQ ID NO: 2092 - protein, 211 aa, Neisseria meningitidis
MNRRNARIERAVRIAVIDVLNVDAPGSGTLLHQRGKQVGSRNDALADIRVLLVFRIEPLKFVLVGKKRFVQSRNLVGRKQRNVAALNQAGVQQAVDLHAVIKLTDTVVFHAPVVFQHQQAFGFDMPQGVEQGCRAAAHATLRTGFDCRLKHFKEGNAAGMPCFAAPDFAVQSADTSGIDADARTLGNVFHNRAGSGVDGIQAVVAFDQYAA

SEQ ID NO: 2093 - DNA, 312 bp, Neisseria gonorrhoeae
atgcttgccatactgttgtctgcaatactgggactggtatcaacaactgccgctgccggtacgtcagaacccgcccaccgacataccaaacatatcagcaaggcaaacaagcagatgctgcaccccgaatgcaggaaatatttggaacgccgtgccgcgtggtaccgatcgcaaggcaacgtgcaggaattgcgcgaaaacaaaaaggcgcgcaaagcattccgcaccctgccttatgcggaacagaaaatccaatgccgggcggcttatgaggctttcgatgatttcgacggcggcaggttccgccgttaa

SEQ ID NO: 2094 - protein, 103 aa, Neisseria gonorrhoeae
MLAILLSAILGLVSTTAAAGTSEPAHRHTKHISKANKQMLHPECRKYLERRAAWYRSQGNVQELRENKKARKAFRTLPYAEQKIQCRAAYEAFDDFDGGRFRR

SEQ ID NO: 2095 - DNA, 312 bp, Neisseria meningitidis
atgcttgccatactgttgtctgcaatattgggactggtatcgacaactgccgctgccggtacgtcagaacccgcccaccgcgataccaaacatatccgcaaggcaaacaagcagatgctgcaccccgaatgcaggaaatatttggaacgccgtgccgcgtggtaccgatcgcaaggcaacgtgcaggaattgcgcgaaaacaaaaaggcgcgcaaagcattccgctccctgccttatgcggaacagaaaatccaatgccgggcggcttatgaggctttcgatgatttcgacggcggcagtttccgccgttaa

SEQ ID NO: 2096 - protein, 103 aa, Neisseria meningitidis
MLAILLSAILGLVSTTAAAGTSEPAHRDTKHIRKANKQMLHPECRKYLERRAAWYRSQGNVQELRENKKARKAFRSLPYAEQKIQCRAAYEAFDDFDGGSFRR

SEQ ID NO: 2097 - DNA, 312 bp, Neisseria meningitidis
atgcttgccatactgttgtctgcaatattgggactggtatcgacaactgccgctgccggtacgtcagaacccgcccaccgcgataccaaacatatccgcaaggcaaacaagcagatgctgcaccccgaatgcaggaaatatttggaacgccgtgccgcgtggtaccgatcgcaaggcaacgtgcaggaattgcgcgaaaacaaaaaggcgcgcaaagcattccgctccctgccttataaggaacagaaaacccaatgccgggcggcttatgaggctttcgatgatttcgacggcagcaggttccgccgttaa

SEQ ID NO: 2098 - protein, 103 aa, Neisseria meningitidis
MLAILLSAILGLVSTTAAAGTSEPAHRDTKHIRKANKQMLHPECRKYLERRAAWYRSQGNVQELRENKKARKAFRSLPYKEQKTQCRAAYEAFDDFDGSRFRR

SEQ ID NO: 2099 - DNA, 1398 bp, Neisseria gonorrhoeae
atgtccaaactcaaaaccatcgccctgaccgcatcaggtctgtccgtttgtccgggtttcctatatgcccaaaacacctcatcacaccaagtcggtttagcgattatgcggttaaactcttcaatactcgacctgccaccgacaaaacaatatttccaatccggcagcctgtgggacgagctgcgccaaggcttccggatgggcgaagtcaatcccgaactggtacgccgccacgaaagcaaattcatcgcaagccgcagctatttcgacagggtcgtcaaccggagccgaccctatatgtaccatatcgccaacgaagtcaaaaaacgcaatatgcccgccgaagccgccctgcttcccttcatcgaaagcgcgttcgtcaccaaagccaaatcacacgtcggcgcatcgggcctgtggcagttcatgcccgctaccggcaggcattacggcttggaaaaaacaccggtttacgacggcaggcacgacgtttacgcagctaccgatgccgcactcaactatctgcaatatctctatggactgttcggcgactggccgctcgcctttgccgcctacaactggggtgaaggcaacgtcggacgcgccgtcaaccgcgcccgcgaccaagggctcgaaccgacctacgaaaacctgcgtatgcccaacgaaacgcgcaactatgtccccaagctgctcgccgtgcgcaacattattgccaccccccaatctttcggcatgaatatcagcgacatagacaacaaaccctattttcaggcagtcgaaccgggccgtccgctcgacaacgaagccatcgcccggcttgccggcatcacgcaaagcgagctgctcgccctgaatcctgcattcaacgtccccgcgttcatccccaaaaacaaacgcaaactgctgcttcctgtcgcgtccgtccaaaccttccaaagcaactacctcaacgccgcacccgacagcctgttttcatgggaagtctatacgcctgccgccaaaaccagcctgtccgacatctcgacggcaaccggcatgagcattgccgacatcaaacgcctcaacaacctgaacggcaaccttgtcaacgcaggacgcagcatccttgtcgccaagaacggcaagacccttcatacggcatcggaatccgtcgtttccatcgacatcgacaatacgcccgacacctaccgttccaatatgccggcaggcacggtgaacgtcagcattgcccgaatccaacccgccgccgcacagacagcggacattaccgtcgcacctttgccgcaagaaaccgtccgtacgggaacccgatccccttgtccgcattaccgaacccgcccttgcgacagccgcagcgcaacctcaaaccgaaaaacagactgccatgccgtctga

SEQ ID NO: 2100 - protein, 465 aa, Neisseria gonorrhoeae
MSKLKTIALTASGLSVCPGFLYAQNTSSHQVGLAIMRLNSSILDLPPTKQYFQSGSLWDELRQGFRMGEVNPELVRRHESKFIASRSYFDRVVNRSRPYMYHIANEVKKRNMPAEAALLPFIESAFVTKAKSHVGASGLWQFMPATGRHYGLEKTPVYDGRHDVYAATDAALNYLQYLYGLFGDWPLAFAAYNWGEGNVGRAVNRARDQGLEPTYENLRMPNETRNYVPKLLAVRNIIATPQSFGMNISDIDNKPYFQAVEPGRPLDNEAIARLAGITQSELLALNPAFNVPAFIPKNKRKLLLPVASVQTFQSNYLNAAPDSLFSWEVYTPAAKTSLSDISTATGMSIADIKRLNNLNGNLVNAGRSILVAKNGKTLHTASESVVSIDIDNTPDTYRSNMPAGTVNVSIARIQPAAAQTADITVAPLPQETVRTGTRSPCPHYRTRPCDSRSATSNRKTDCHAV

SEQ ID NO: 2101 - DNA, 1397 bp, Neisseria meningitidis
atgtccaaactcaaaaccatcgctctgaccgcatcaggtctgtccgtttgtccgggtttcctatacgcccaaaacacctcatcacaccaaatcggtttggcgattatgcgcttaaactcttcaatactcgacctgcccccgacaaaacaatatttccaatccggcagcctgtggggcgagctgcgccaaggcttccggatgggcgaagtcaatcccgaactggtacgccgccacgaaagcaaattcatcgcaagccacagctatttcaacagggtcatcaaccggagtagaccctatatgtaccatatcgccaacgaagtcaaaaaacgcaatatgcccgccgaagccgccctgcttcccttcatcgaaagcgcgttcgtcaccaaagccaaatcacacgtcggcgcatcaggattatggcagtttatgcccgctaccggcaggcattacggcctggaaaaaacaccggtttacgacggcaggcacgacgtttacgccgccaccgatgccgcactcaactatctgcaatacctctatggactgttcggcgactggccgcttgcctttgccgcctacaactggggtgaaggcaacgtcggacgcgccatcaaccgcgcccgcgcccaagggctcgaaccgacctacgaaaacctgcgtatgcccaacgaaacgcgcaactatgtccccaagctgctcgccgtgcgcaacattattgccactccccaatctttcggcatgaatatcagcgacatagacaacaaaccctattttcaggcagtcgaaccggatcgtccgctcgacaacgaagccatcgcccggcttgccggcatcacgcaaagcgagctgctcgccctaaaccccgcattcaacgtccccgcgtttatccccaaaagcaaacgcaaactgctgcttcctgtcgcgtccgtacaaaccttccaaagcaactacctcaacgccgcacccgacagcctgttttcatgggaagtctatacgcctgccgccaaaaccagcctgtccgacatctcgacggcaaccggcatgagcattgccgacatcaaacgcctcaacaacctgaacggcaaccttgtcaacgcaggacgcagcatccttgtcgccaagaacggcaaaacccttcagacggcatcggaatccgtcgtttccatcgacatcgacaatacgcccgacacctaccgttccaatatgccggcaggcacggtgaacgtcggcattgcccgaatccgacccgccgccgcacagacagcggacattaccgtcgcacctttgccgcagaaaaccgtccgtacggaacccgatccccttgtccgtattgccgaacctgcccttgcgacagccgcagcgcaacctcaaaccgaaaaacagaccgccatgccgtctga

SEQ ID NO: 2102 - protein, 465 aa, Neisseria meningitidis
  misc_feature (436)..(436): Xaa can be any naturally occurring amino acid
MSKLKTIALTASGLSVCPGFLYAQNTSSHQIGLAIMRLNSSILDLPPTKQYFQSGSLWGELRQGFRMGEVNPELVRRHESKFIASHSYFNRVINRSRPYMYHIANEVKKRNMPAEAALLPFIESAFVTKAKSHVGASGLWQFMPATGRHYGLEKTPVYDGRHDVYAATDAALNYLQYLYGLFGDWPLAFAAYNWGEGNVGRAINRARAQGLEPTYENLRMPNETRNYVPKLLAVRNIIATPQSFGMNISDIDNKPYFQAVEPDRPLDNEAIARLAGITQSELLALNPAFNVPAFIPKSKRKLLLPVASVQTFQSNYLNAAPDSLFSWEVYTPAAKTSLSDISTATGMSIADIKRLNNLNGNLVNAGRSILVAKNGKTLQTASESVVSIDIDNTPDTYRSNMPAGTVNVGIARIRPAAAQTADITVAPLPQKTVRTXTRSPCPYCRTCPCDSRSATSNRKTDRHAV

SEQ ID NO: 2103 - DNA, 1397 bp, Neisseria meningitidis
atgtccaaactcaaaaccatcgccctgaccgcgtcaggtctgtccgtttgtccgggtttcctatacgcccaaaacacctcatcacaccaaatcggtttggcgattatgcgcttaaactcttcaatactcgacctgccaccgacaaaacaatatttccaatccggcagcctgtggagcgagctgcgccaaggcttccggatgggcgaagtcaatcccgaactggtacgccgccacgaaagcaaattcatcgcaagccacagctatttcaacagggtcatcaaccggagtagaccctatatgtaccatatcgccaacgaagtcaaaaaacgcaatatgcccgccgaagccgccctgcttcccttcatcgaaagcgcgttcgtcaccaaagccaaatcacacgtcggcgcatcgggcctgtggcagttcatgcccgctaccggcaggcattacggcctggaaaaaacaccggtttacgacggcaggcacgacatttacgccgccaccgatgccgcactcaactatctgcaatacctctatggactgttcggcgactggccgctcgcctttgccgcctacaactggggtgaaggcaacgtcggacgcgccatcaaccgcgcccgcgcccaagggctcgaaccgacctacgaaaacctgcgtatgcccaacgaaacgcgcaactatgttcccaagctgctcgccgtgcgcaacatcattgccgccccccaatctttcggcatgaatatcagcgacatagacaacaaaccgtattttcaggcagtcgaaccggaccgtccgctcgacaacgaagccatcgcccggcttgccggcatcacgcaaagcgagctgctcgccctaaaccccgcattcaacgtccccgcgttcatccccaaaagcaaacgcaaactgctgcttcctgtcgcgtccgtacaaaccttccaaagcaactacctcaacgccgcacccgacagcctgttttcatgggaagtctatacgcctgccgccaaaaccagcttgtccgacatctcgacggcaaccggcatgagcattgccgacatcaaacgcctcaacaacctgaacggcaaccttgtcaacgcaggacgcagcatccttgtcgccaagaacggcaaaacccttcagacggcatcggaatccgtcgtttccatcgacatcgacaatacgcccaacacctaccgttccaatatgccggcaggcacggtgaacgtcggcattgcccgaatccgacccgccgccgcacagacagcggacattaccgtcgcacctttgccgcagaaaaccgtccgtacggaacccgatccccttgtccgtattgccgaacctgcccttgcgacagccgcagcgcaacctcaaaccgaaaaacagaccgccatgccgtctga

SEQ ID NO: 2104 - protein, 465 aa, Neisseria meningitidis
  misc_feature (436)..(436): Xaa can be any naturally occurring amino acid
MSKLKTIALTASGLSVCPGFLYAQNTSSHQIGLAIMRLNSSILDLPPTKQYFQSGSLWSELRQGFRMGEVNPELVRRHESKFIASHSYFNRVINRSRPYMYHIANEVKKRNMPAEAALLPFIESAFVTKAKSHVGASGLWQFMPATGRHYGLEKTPVYDGRHDIYAATDAALNYLQYLYGLFGDWPLAFAAYNWGEGNVGRAINRARAQGLEPTYENLRMPNETRNYVPKLLAVRNIIAAPQSFGMNISDIDNKPYFQAVEPDRPLDNEAIARLAGITQSELLALNPAFNVPAFIPKSKRKLLLPVASVQTFQSNYLNAAPDSLFSWEVYTPAAKTSLSDISTATGMSIADIKRLNNLNGNLVNAGRSILVAKNGKTLQTASESVVSIDIDNTPNTYRSNMPAGTVNVGIARIRPAAAQTADITVAPLPQKTVRTXTRSPCPYCRTCPCDSRSATSNRKTDRHAV

SEQ ID NO: 2105 - DNA, 1008 bp, Neisseria gonorrhoeae
atgatcgaattggacggtactgaaaacaaaggcaatttgggtgcgaatgcgactttggcggtctctatggcggttgcacgcgccgctgccgaagactcaggcctgccgctttaccgctacttggggggcgcaggtccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagtaaaggcttcccgaccacagtcggcgacgaaggcggtttcgcccccaacctgaacagccacaaagaagccctgcaactgatggtcgaagcggccgaagccgccggctacaaggcgggcgaagacgtattattcgcattggactgcgcgtccagcgagttctacaaagacggcaaataccacttggaagccgaaggccgctcctacaccaacgcggaatttgccgaatacttggaaggcttggttaacgaattcccgattatttccattgaagacgggatggacgaaaacgactgggaaggctggaaactgctgaccgaaaaattgggcaaaaaagttcaattggtcggcgacgacttgttcgtaaccaatccgaaaattcttgccgaaggcatcgaaaaaggcgtagcaaacgcattgctggtcaaagtcaaccaaatcggtactttaagcgaaaccctgaaagccgtcgatctggcaaaatgcaaccgctacgccagcgtgatgagccaccgctccggcgaaaccgaagacagtaccattgccgacttggcagtcgccaccaactgtatgcagattaaaaccggttctttgagccgttccgaccgcatggcgaaatacaaccaactgctgcgtatcgaggaagaattggcggaagccgcctactaccccggcaaagccgcattctaccaactgggcaaataa

SEQ ID NO: 2106 - protein, 335 aa, Neisseria gonorrhoeae
MIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEAAEAAGYKAGEDVLFALDCASSEFYKDGKYHLEAEGRSYTNAEFAEYLEGLVNEFPIISIEDGMDENDWEGWKLLTEKLGKKVQLVGDDLFVTNPKILAEGIEKGVANALLVKVNQIGTLSETLKAVDLAKCNRYASVMSHRSGETEDSTIADLAVATNCMQIKTGSLSRSDRMAKYNQLLRIEEELAEAAYYPGKAAFYQLGK

SEQ ID NO: 2107 - DNA, 1008 bp, Neisseria meningitidis
atgatcgaattggacggtactgaaaacaaaggcaatttgggtgcgaatgcgactttggcggtttctatggcggttgcacgcgccgctgccgaagactcaggcctgccgctttaccgctacttgggcggcgcaggcccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagcaaaggcttcccgaccacagtcggcgacgaaggcggtttcgcccccaacctgaacagccacaaagaagccctgcaactgatggtcgaggcgaccgaagccgccggctacaaagcgggcgaagacgtattattcgcattggactgcgcctccagcgagttctacaaagacggcaaataccacttggaagccgaaggccgctcctacaccaacgcggaatttgccgaatatctggaaggcctggtcaacgagttccccatcatctccatcgaagacggcatggatgaaaacgactgggaaggctggaaactgctgaccgaaaaactgggcggtagagttcaattggttggcgacgacttgttcgtaaccaatccaaaaatcttggccgaaggcatcgaaaaaggcgtagcaaacgcattgctggtcaaagtcaatcaaatcggtactttgagcgagaccctgaaagccgtcgacttagccaaacgcaaccgctacgccagcgtaatgagccaccgctccggcgaaaccgaagacagcaccattgccgacttggcagtcgccaccaactgtatgcagatcaaaaccggttctttgagccgttccgaccgcatggcgaaatacaaccaactgctgcgtatcgaggaagaattggcggaagccgccgactaccccagcaaagccgcattctaccaactgggcaaataa

SEQ ID NO: 2108 - protein, 335 aa, Neisseria meningitidis
MIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGRVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 2109 - DNA, 1008 bp, Neisseria meningitidis
atgatcgaattggacggtactgaaaacaaaggcaatttgggtgcgaatgcgactttggcggtttctatggcggttgcacgcgccgctgccgaagactcaggcctgccgctttaccgctacttgggcggcgcaggcccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagcaaaggcttcccgaccacagtcggcgacgaaggcggtttcgcccccaacctgaacagccacaaagaagccctgcaactgatggtcgaggcgaccgaagccgccggctacaaagcgggcgaagacgtattattcgcattggactgcgcgtccagcgagttctacaaagacggcaaataccacttggaagccgaaggccgctcctacaccaacgcggaatttgccgaatatctggaaggcctggtcaacgagttccccatcatctccatcgaagacgggatggatgaaaacgactgggaaggctggaaactgctgaccgaaaaactgggcggcaaagtccaactcgttggcgacgacctcttcgttaccaacccgaaaatccttgccgaaggcattgaaaaaggcgtggcaaacgcactattggtcaaagtcaaccaaatcggtactttgagtgaaaccctgaaagccgtcgacttagccaaacgcaaccgctacgccagcgtaatgagccaccgctccggcgaaaccgaagacagcaccattgccgacttggcagtcgccaccaactgtatgcagatcaaaaccggttctttgagccgttccgaccgcatggcgaaatacaaccaactgctgcgtatcgaggaagaattggcggaagccgccgactaccccagcaaagccgcattctaccaactgggcaaataa

SEQ ID NO: 2110 - protein, 335 aa, Neisseria meningitidis
MIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGKVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 2111 - DNA, 1287 bp, Neisseria gonorrhoeae
atgagcgcaatcgttgatattttcgcccgcgaaattttggactcacgcggcaaccccacagtcgagtgtgatgtattgctcgaatccggcgtaatgggacgtgcggccgtaccgagcggcgcatccaccggtcagaaagaagctttggaacttcgcgacggcgacaaatcccgctattccggcaaaggcgtattgaaggccgtcgaacacgtcaacaaccaaatcgcccaagccctcatcggtatcgatgccaacgagcaatcttatatcgaccaaatcatgatcgaattggacggtactgaaaacaaaggcaatttgggtgcgaatgcgactttggcggtctctatggcggttgcacgcgccgctgccgaagactcaggcctgccgctttaccgctacttggggggcgcaggtccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagtaaaggcttcccgaccacagtcggcgacgaaggcggtttcgcccccaacctgaacagccacaaagaagccctgcaactgatggtcgaagcggccgaagccgccggctacaaggcgggcgaagacgtattattcgcattggactgcgcgtccagcgagttctacaaagacggcaaataccacttggaagccgaaggccgctcctacaccaacgcggaatttgccgaatacttggaaggcttggttaacgaattcccgattatttccattgaagacgggatggacgaaaacgactgggaaggctggaaactgctgaccgaaaaattgggcaaaaaagttcaattggtcggcgacgacttgttcgtaaccaatccgaaaattcttgccgaaggcatcgaaaaaggcgtagcaaacgcattgctggtcaaagtcaaccaaatcggtactttaagcgaaaccctgaaagccgtcgatctggcaaaatgcaaccgctacgccagcgtgatgagccaccgctccggcgaaaccgaagacagtaccattgccgacttggcagtcgccaccaactgtatgcagattaaaaccggttctttgagccgttccgaccgcatggcgaaatacaaccaactgctgcgtatcgaggaagaattggcggaagccgcctactaccccggcaaagccgcattctaccaactgggcaaataa

SEQ ID NO: 2112 - protein, 428 aa, Neisseria gonorrhoeae
MSAIVDIFAREILDSRGNPTVECDVLLESGVMGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEAAEAAGYKAGEDVLFALDCASSEFYKDGKYHLEAEGRSYTNAEFAEYLEGLVNEFPIISIEDGMDENDWEGWKLLTEKLGKKVQLVGDDLFVTNPKILAEGIEKGVANALLVKVNQIGTLSETLKAVDLAKCNRYASVMSHRSGETEDSTIADLAVATNCMQIKTGSLSRSDRMAKYNQLLRIEEELAEAAYYPGKAAFYQLGK

SEQ ID NO: 2113 - DNA, 1287 bp, Neisseria meningitidis
atgagcgcaatcgttgatattttcgcccgcgaaattttggactcacgcggcaaccccacagtcgagtgtgatgtattgctcgaatccggcgtaatgggacgcgcagccgtaccgagcggcgcgtccaccggtcaaaaagaggctttggaacttcgcgacggcgacaaatcccgttattcgggcaagggcgtattgaaggcggtcgaacacgtcaacaaccaaatcgcccaagccctcattggtatcgatgccaacgagcaatcttatatcgaccaaatcatgatcgaattggacggtactgaaaacaaaggcaatttgggtgcgaatgcgactttggcggtttctatggcggttgcacgcgccgctgccgaagactcaggcctgccgctttaccgctacttgggcggcgcaggcccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagcaaaggcttcccgaccacagtcggcgacgaaggcggtttcgcccccaacctgaacagccacaaagaagccctgcaactgatggtcgaggcgaccgaagccgccggctacaaagcgggcgaagacgtattattcgcattggactgcgcctccagcgagttctacaaagacggcaaataccacttggaagccgaaggccgctcctacaccaacgcggaatttgccgaatatctggaaggcctggtcaacgagttccccatcatctccatcgaagacggcatggatgaaaacgactgggaaggctggaaactgctgaccgaaaaactgggcggtagagttcaattggttggcgacgacttgttcgtaaccaatccaaaaatcttggccgaaggcatcgaaaaaggcgtagcaaacgcattgctggtcaaagtcaatcaaatcggtactttgagcgagaccctgaaagccgtcgacttagccaaacgcaaccgctacgccagcgtaatgagccaccgctccggcgaaaccgaagacagcaccattgccgacttggcagtcgccaccaactgtatgcagatcaaaaccggttctttgagccgttccgaccgcatggcgaaatacaaccaactgctgcgtatcgaggaagaattggcggaagccgccgactaccccagcaaagccgcattctaccaactgggcaaataa

SEQ ID NO: 2114 - protein, 428 aa, Neisseria meningitidis
MSAIVDIFAREILDSRGNPTVECDVLLESGVMGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGRVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 2115 - DNA, 1287 bp, Neisseria meningitidis
atgagcgcaatcgttgatattttcgcccgcgaaattttggactcacgcggcaaccccacagtcgagtgtgatgtattgctcgaatccggcgtaatgggacgcgcagccgtaccgagcggcgcgtccaccggtcaaaaagaggctttggaacttcgcgacggcgacaaatcccgttattcgggcaagggcgtattgaaggcggtcgaacacgtcaacaaccaaatcgcccaagccctcattggtatcgatgccaacgagcaatcttatatcgaccaaatcatgatcgaattggacggtactgaaaacaaaggcaatttgggtgcgaatgcgactttggcggtttctatggcggttgcacgcgccgctgccgaagactcaggcctgccgctttaccgctacttgggcggcgcaggcccgatgtccctgcccgtaccgatgatgaacgtcatcaacggcggcgaacacgccaacaacagcctgaacatccaagagtttatgattatgcccgtcggcgcaaaatctttccgcgaagcgttgcgctgcggtgcggaaattttccacgccttgaaaaaactgtgcgacagcaaaggcttcccgaccacagtcggcgacgaaggcggtttcgcccccaacctgaacagccacaaagaagccctgcaactgatggtcgaggcgaccgaagccgccggctacaaagcgggcgaagacgtattattcgcattggactgcgcgtccagcgagttctacaaagacggcaaataccacttggaagccgaaggccgctcctacaccaacgcggaatttgccgaatatctggaaggcctggtcaacgagttccccatcatctccatcgaagacgggatggatgaaaacgactgggaaggctggaaactgctgaccgaaaaactgggcggcaaagtccaactcgttggcgacgacctcttcgttaccaacccgaaaatccttgccgaaggcattgaaaaaggcgtggcaaacgcactattggtcaaagtcaaccaaatcggtactttgagtgaaaccctgaaagccgtcgacttagccaaacgcaaccgctacgccagcgtaatgagccaccgctccggcgaaaccgaagacagcaccattgccgacttggcagtcgccaccaactgtatgcagatcaaaaccggttctttgagccgttccgaccgcatggcgaaatacaaccaactgctgcgtatcgaggaagaattggcggaagccgccgactaccccagcaaagccgcattctaccaactgggcaaataa

SEQ ID NO: 2116 - protein, 428 aa, Neisseria meningitidis [sequence omitted]

SEQ ID NO: 2117 - DNA, 492 bp, Neisseria gonorrhoeae
atggcggcggaaccgatgcggatgccggaggtaacgtacggtttttccggatcgttcgggatggcgtttttgttgacggtgatgtgcgctttgcccaaagcggcttcggcggctttgccggtgattttcatcggttgcaggtcgacgaggaaaacgtggctttcggtgcggccggaaacgatgcgcaaaccgcgtttaaccaactcttccgccatgacggcagcattgattttcacttgttttgcgtattgtttgaactcgggttgcaacgcttctttaaacgctacggctttggcggcgataacgtgcatcaacggaccgccttgcaggcttgggaagatggaagagttcagcgctttttcgtgggtattgtcacggcacaaaatcacaccgccgcgagggccgcgtagggttttgtgggtggtagtggttacgaagtcgcagaatggcacggggttaggatattcgccgccggcaaccagtccggcatag

SEQ ID NO: 2118 - protein, 163 aa, Neisseria gonorrhoeae
MAAEPMRMPEVTYGFSGSFGMAFLLTVMCALPKAASAALPVIFIGCRSTRKTWLSVRPETMRKPRLTNSSAMTAALIFTCFAYCLNSGCNASLNATALAAITCINGPPCRLGKMEEFSAFSWVLSRHKITPPRGPRRVLWVVVVTKSQNGTGLGYSPPATSPA

SEQ ID NO: 2119 - DNA, 492 bp, Neisseria meningitidis
atggcagcggagccgatgcggatgccggaggtaacgaagggtttttccggatcgttcggaatggcgtttttgttgacggtgatgtgcgctttgcccaaagcggcttcggcggctttgccggtaattttcatcggttgcaggtcaacgaggaaaacgtggctttcggtgcggccggaaacgatgcgcaaaccgcgtttaaccaactcttccgccatggcggctgcattgattttcacttgttttgcgtattgtttgaactcgggttgcaatgcttctttaaacgccacggctttggcggcgataacgtgcatcagcggaccgccttgcaggcttgggaagatggaagagttcaacgctttttcgtgggtattgtcgcggcacaaaattacgccgccgcgaggaccgcgcagggttttgtgggtggtggtggtcacgaagtcgcagaacggcaccgggttgggatattcgccgccggcaaccagaccggcatag

SEQ ID NO: 2120 - protein, 163 aa, Neisseria meningitidis
MAAEPMRMPEVTKGFSGSFGMAFLLTVMCALPKAASAALPVIFIGCRSTRKTWLSVRPETMRKPRLTNSSAMAAALIFTCFAYCLNSGCNASLNATALAAITCISGPPCRLGKMEEFNAFSWVLSRHKITPPRGPRRVLWVVVVTKSQNGTGLGYSPPATRPA

SEQ ID NO: 2121 - DNA, 492 bp, Neisseria meningitidis
atggcggcggaaccgatgcggatgccggaggtaacgaagggtttttccggatcattcgggatggcgtttttgttgacagtgatgtgcgctttgcccaaagcagcttcggcggctttgccggtaattttcatcggttgcaggtcaacgaggaaaacgtggctttcggtgcggccggaaacgatgcgcaaaccgcgtttaaccaactcttccgccatggcggctgcattgattttcacttgttttgcgtattgtttgaactcgggttgcaatgcttctttaaacgccacggctttggcggcgataacgtgcatcagcgggccaccttgcaggcttgggaagatggaagagttcaacgctttttcgtgggtattgtcgcggcacaaaattacgccgccgcgaggaccgcgcagggttttgtgggtggtggtggtaacgaagtcgcagaacggcacgggattgggatattcgccgccggcaaccagaccggcatag

SEQ ID NO: 2122 - protein, 163 aa, Neisseria meningitidis; identical to SEQ ID NO: 2120

SEQ ID NO: 2123 - DNA, 435 bp, Neisseria gonorrhoeae
atgccgcgtttctccggttcgatttcttcgatgatttccatcgcgcggacttttggcgcgccggagagtgtgccggcagggaaggtggcggcgaggatgtccatattggtaacgccctctttcaaacagccttcgacgttggaaacgatgtgcatcacatgggagtatttttcaatcaccattttgtcggtgactttgacttcgcctgttttgctgatgcgtccgacatcgttgcgccccaaatcgataagcataacgtgttcggcgatttctttggcgtcgcttaacaaatcttgttcgttggcaaggtcttcggcgggggttttgccgcgcaggcgcgtgccggcgatggggcggacgatgacgtcatcgcgttcgcggcggacgaggatttcgggcgaggaaccgacgatgtggaaatcgccgaaatcgtag

SEQ ID NO: 2124 - protein, 144 aa, Neisseria gonorrhoeae
MPRFSGSISSMISIARTFGAPESVPAGKVAARMSILVTPSFKQPSTLETMCITWEYFSITILSVTLTSPVLLMRPTSLRPKSISITCSAISLASLNKSCSLARSSAGVLPRRRVPAMGRTMTSSRSRRTRISGEEPTMWKSPKS

SEQ ID NO: 2125 - DNA, 435 bp, Neisseria meningitidis
atgccgcgtttgctcggttcgacttcttcgatgatttccatggcgcggactttgggtgcgccggagagtgtgccggcagggaaggtagcggcgaggatgtccatgttggtcatgccgtctttcagacggccttcgacgttggaaacgatgtgcattacatgggagtatttttcaatcaccattttgtcggtaactttgacttcgccggttttactgatgcggccgacgtcgttgcgtcctaagtcaatcaacatgacgtgttcggcgatttctttggcatcgcttaacaaatcttgttcgttggcaaggtcttcggcgggggttttgccgcgcaggcgcgtgccggcgatggggcggacgataacgtcgttgcgttcgcgtcggacgaggatttcgggcgaggagccgacgatgtggaaatcgccgaaatcgtag

SEQ ID NO: 2126 - protein, 144 aa, Neisseria meningitidis
MPRLLGSTSSMISMARTLGAPESVPAGKVAARMSMLVMPSFRRPSTLETMCITWEYFSITILSVTLTSPVLLMRPTSLRPKSINMTCSAISLASLNKSCSLARSSAGVLPRRRVPAMGRTITSLRSRRTRISGEEPTMWKSPKS

SEQ ID NO: 2127 - DNA, 435 bp, Neisseria meningitidis
atgccgcgtttgctcggttcgacttcttcgatgatttccatggcgcggactttgggtgcgccggagagtgtgccggcagggaaggtagcggcgaggatgtccatgttggtcatgccgtctttcagacggccttcgacgttggaaacgatgtgcattacatgggagtatttttcaatcaccattttgtcggtaactttgacttcgccggttttactgatgcggccgacgtcgttgcgtcctaagtcaatcaacatgacgtgttcggcgatttctttggcatcgcttaacaaatcttgttcgttggcaaggtcttcggcgggggttttgccgcgcaggcgcgtgccggcgatggggcggacgatgacatcgtcgcgttcgcggcggacgaggatttcgggcgaggagccgacgatgtggaaatcgccgaaatcgtag

SEQ ID NO: 2128 - protein, 144 aa, Neisseria meningitidis
MPRLLGSTSSMISMARTLGAPESVPAGKVAARMSMLVMPSFRRPSTLETMCITWEYFSITILSVTLTSPVLLMRPTSLRPKSINMTCSAISLASLNKSCSLARSSAGVLPRRRVPAMGRTMTSSRSRRTRISGEEPTMWKSPKS

SEQ ID NO: 2129 - DNA, 1137 bp, Neisseria gonorrhoeae
atgaacacaccccccatccttcctcccgccatgctcggcatcctcggcggcggacaattaggcagaatgtttgccgttgccgctaaaaccatgggctacaaagtaaccgttctcgatcccgacccgaatgcgccggcggcggaatttgccgaccgccatttgtgcgcgccgtttgacgaccgggccgcgttggacgaattggcaaaatgcgcggcggttacgaccgaatttgaaaacgtcaatgccgacgcgatgcgctctctggcaaagcataccaacgtttcccccagcggcgactgcgtgtccattgcacaaaaccgcattcaggaaaaagcgtggatacgcaaagcaggcttgcaaaccgcgccgtatcaggcggtttgcaaggccgaagacattactgaagcaagcgcgcaatttttgcccggcatcctgaaaacggctacgttgggctacgacggcaaaggtcaaatccgcgtcaaaacgttggacgaactcaaagccgcgtttgccgaacacggcggcgtggattgcgttttggaaaaaatggtggacttgcgcggcgagatttccgtgatcgtatgccgtctgaacgatgaaaacgtgcaaaccttcgaccccgccgaaaacatccacgaaaacggcatcttggcttattccatcgtccccgcgcggctgagtgccgacgtgcagcaacaggcgcggcagacggcgcaacgcttggcggacgaattggattatgtcggcgtattggcggtagaaatgtttgttgtcggcgacacacatgaattgctcgtcaatgaaaccgccccgcgcacgcacaattccggccaccatacgatagatgcctgcgccgcagaccagttccaacagcaggtacgcattatgtgcaacctgccgcccgccgacaccaaattattatccccttgctgtatggcgaatattttgggcgacgtttggcaggaagatggcggcgaaccggattggctgccgttgcaaagccggccgaatgcacacctgcacctatacggaaaaaaaaccgcacagaaaggtcggaaaatgggacactttaccgttttgaccaccgattcggacaccgcatttcaagaagcaaaaaaactgcatcagtccctataa

SEQ ID NO: 2130 - protein, 378 aa, Neisseria gonorrhoeae
MNTPPILPPAMLGILGGGQLGRMFAVAAKTMGYKVTVLDPDPNAPAAEFADRHLCAPFDDRAALDELAKCAAVTTEFENVNADAMRSLAKHTNVSPSGDCVSIAQNRIQEKAWIRKAGLQTAPYQAVCKAEDITEASAQFLPGILKTATLGYDGKGQIRVKTLDELKAAFAEHGGVDCVLEKMVDLRGEISVIVCRLNDENVQTFDPAENIHENGILAYSIVPARLSADVQQQARQTAQRLADELDYVGVLAVEMFVVGDTHELLVNETAPRTHNSGHHTIDACAADQFQQQVRIMCNLPPADTKLLSPCCMANILGDVWQEDGGEPDWLPLQSRPNAHLHLYGKKTAQKGRKMGHFTVLTTDSDTAFQEAKKLHQSL

SEQ ID NO: 2131 - DNA, 1137 bp, Neisseria meningitidis
atgaaaaacatatctctttctccgcccgccatgcttggcatcctcggcggcggacaattaggcagaatgtttaccgttgccgccaaaaccatgggctacaaagtaaccgttctcgaccccgatccggacgcgccggcagcagaatttgccgaccgccatttgtgcgcgccgtttaacgaccaagctgctttggacgaattggcaaaatgcgcggcggtgaccactgaatttgaaaacgtcaatgccgatgcgatgcgctttttggcaaaacataccaatgtttcccctagcggcgattgtgtggcgattgcacaaaaccgcattcaggaaaaggcatggatacgcaaagcgggattgcaaaccgcgccgtatcaagtggtttgtaaggctgaagacatcactgaagcaagcgcgcaatttttgcccggcatcctgaaaacggctacgttgggctacgacggcaaaggtcaaatccgcgtaaaaacattggatgaactcaaagccgcgtttgccgaacacggcggcgtggattgcgttttggaaaaaatggtggatttgcgcagtgaaatttccgtaatcgtatgccgtttgaacaatgacaacgtgcaaactttcgaccctgccgaaaacatccacgaaaacggcatcttggcttattccatcgtccccgcgcgactgagtgccgacgtgcagcaacaggcgcggcagatggcgcaacgcttggcggacgaattggattatgtcggcgtattggcggtagaaatgtttgttgtcggtgacacgcatgaattggtcgtcaacgaaatcgccccgcgcccgcacaattccggacaccatacgatagatgcctgcgcagcagaccagttccagcagcaggtacgcattatgtgcaacctgccgcctgccgataccaaattactgagttcttgctgtatggcaaatattttgggcgacgtttggcaggaagacggcggcgaaccggattggctgcccttgcaaagccatccgaatgcacacctgcacctttacggcaaaaaaaccgcgcacaaagggcggaaaatgggacactttaccgttttaaccaccgattcggacaccgcatttcaagaagcaaaaaaactgcatcagtccctataa

SEQ ID NO: 2132 - protein, 378 aa, Neisseria meningitidis
MKNISLSPPAMLGILGGGQLGRMFTVAAKTMGYKVTVLDPDPDAPAAEFADRHLCAPFNDQAALDELAKCAAVTTEFENVNADAMRFLAKHTNVSPSGDCVAIAQNRIQEKAWIRKAGLQTAPYQVVCKAEDITEASAQFLPGILKTATLGYDGKGQIRVKTLDELKAAFAEHGGVDCVLEKMVDLRSEISVIVCRLNNDNVQTFDPAENIHENGILAYSIVPARLSADVQQQARQMAQRLADELDYVGVLAVEMFVVGDTHELVVNEIAPRPHNSGHHTIDACAADQFQQQVRIMCNLPPADTKLLSSCCMANILGDVWQEDGGEPDWLPLQSHPNAHLHLYGKKTAHKGRKMGHFTVLTTDSDTAFQEAKKLHQSL

SEQ ID NO: 2133 - DNA, 1137 bp, Neisseria meningitidis
atgaaaaacatatctctttctccgcccgccatgctcggcattcttggcggcggacaattaggcagaatgtttactgttgctgccaaaaccatgggctacaaagtaaccgtactcgatcccaacccgaatgcgccggcagcggaatttgccgaccgccatttgtgtgcgccgtttgacaaccaaaccgctttggaagaattggcaaaatgtgcggctgttacgaccgagttcgaaaacgtcaatgccgatgcgatgcgttttctcgccaaacataccaatgtttcccccagcggcgactgcgttgccatcgcgcaaaaccgcattcaggaaaaggcatggatacgcaaagcaggcctgcaaaccgcgccgtatcaagcaatttgcaaagccgaagacatcactgaagaaagcatacaatttctgcccggcatcctgaaaaccgctacattgggctatgacggcaaaggccaaatccgcgtcaaaacggtggatgaactcaaagccgcgtttgccgaacaccgcggcgtggattgcgttttggaaaaaatggtggacttgcgcggcgaaatttccgttatcgtatgccgtctgaacaatgacaacgtgcaaactttcgatcctgccgaaaacattcacgaaaacggtatcctcgcctactccatcgtcccagcccgactgagtgccgacattcagcaacaggcgcgacaaatggcgcagcgtttggccgatgaattgaactacgtcggcgtattggcggtagaaatgtttgttgtcggcgacacgcatgaattggtcgtcaacgaaatcgcgccgcgtccgcacaattccggccaccataccgtcgacgcctgcgcggcagaccaattccagcaacaggtccgcctgatgtgcaacctgccacctgctgacaccaaattgctgagttcttgctgtatggcgaatattttgggcgacgtttggcaggaagacggcggcgaaccggattggtttcccctgcaaagccggccggacgcgcacctgcacctttacggcaaaaaaaccgcgcacaaagggcggaaaatgggacactttaccattttaagcaccgattcggacaccgcatttcaagaagcaaaaaaactgcatcagtccctataa

SEQ ID NO: 2134 - protein, 378 aa, Neisseria meningitidis
MKNISLSPPAMLGILGGGQLGRMFTVAAKTMGYKVTVLDPNPNAPAAEFADRHLCAPFDNQTALEELAKCAAVTTEFENVNADAMRFLAKHTNVSPSGDCVAIAQNRIQEKAWIRKAGLQTAPYQAICKAEDITEESIQFLPGILKTATLGYDGKGQIRVKTVDELKAAFAEHRGVDCVLEKMVDLRGEISVIVCRLNNDNVQTFDPAENIHENGILAYSIVPARLSADIQQQARQMAQRLADELNYVGVLAVEMFVVGDTHELVVNEIAPRPHNSGHHTVDACAADQFQQQVRLMCNLPPADTKLLSSCCMANILGDVWQEDGGEPDWFPLQSRPDAHLHLYGKKTAHKGRKMGHFTILSTDSDTAFQEAKKLHQSL

SEQ ID NO: 2135 - DNA, 780 bp, Neisseria gonorrhoeae
atggtggccggaattgtgcgtgcgcggggcggtttcattgacgagcaattcatgtgtgtcgccgacaacaaacatttctaccgccaatacgccgacataatccaattcgtccgccaagcgttgcgccgtctgccgcgcctgttgctgcacgtcggcactcagccgcgcggggacgatggaataagccaagatgccgttttcgtggatgttttcggcggggtcgaaggtttgcacgttttcatcgttcagacggcatacgatcacggaaatctcgccgcgcaagtccaccattttttccaaaacgcaatccacgccgccgtgttcggcaaacgcggctttgagttcgtccaacgttttgacgcggatttgacctttgccgtcgtagcccaacgtagccgttttcaggatgccgggcaaaaattgcgcgcttgcttcagtaatgtcttcggccttgcaaaccgcctgatacggcgcggtttgcaagcctgctttgcgtatccacgctttttcctgaatgcggttttgtgcaatggacacgcagtcgccgctgggggaaacgttggtatgctttgccagagagcgcatcgcgtcggcattgacgttttcaaattcggtcgtaaccgccgcgcattttgccaattcgtccaacgcggcccggtcgtcaaacggcgcgcacaaatggcggtcggcaaattccgccgccggcgcattcgggtcgggatcgagaacggttactttgtagcccatggttttagcggcaacggcaaacattctgcctaa

SEQ ID NO: 2136 - protein, 259 aa, Neisseria gonorrhoeae
MVAGIVRARGGFIDEQFMCVADNKHFYRQYADIIQFVRQALRRLPRLLLHVGTQPRGDDGISQDAVFVDVFGGVEGLHVFIVQTAYDHGNLAAQVHHFFQNAIHAAVFGKRGFEFVQRFDADLTFAVVAQRSRFQDAGQKLRACFSNVFGLANRLIRRGLQACFAYPRFFLNAVLCNGHAVAAGGNVGMLCQRAHRVGIDVFKFGRNRRAFCQFVQRGPVVKRRAQMAVGKFRRRRIRVGIENGYFVAHGFSGNGKHSA

SEQ ID NO: 2137 - DNA, 780 bp, Neisseria meningitidis
atggtgtccggaattgtgcgggcgcggggcgatttcgttgacgaccaattcatgcgtgtcaccgacaacaaacatttctaccgccaatacgccgacataatccaattcgtccgccaagcgttgcgccatctgccgcgcctgttgctgcacgtcggcactcagtcgcgcggggacgatggaataagccaagatgccgttttcgtggatgttttcggcagggtcgaaagtttgcacgttgtcattgttcaaacggcatacgattacggaaatttcactgcgcaaatccaccattttttccaaaacgcaatccacgccgccgtgttcggcaaacgcggctttgagttcatccaatgtttttacgcggatttgacctttgccgtcgtagcccaacgtagccgttttcaggatgccgggcaaaaattgcgcgcttgcttcagtgatgtcttcagccttacaaaccacttgatacggcgcggtttgcaatcccgctttgcgtatccatgccttttcctgaatgcggttttgtgcaatcgccacacaatcgccgctaggggaaacattggtatgttttgccaaaaagcgcatcgcatcggcattgacgttttcaaattcagtggtcaccgccgcgcattttgccaattcgtccaaagcagcttggtcgttaaacggcgcgcacaaatggcggtcggcaaattctgctgccggcgcgtccggatcggggtcgagaacggttactttgtagcccatggttttggcggcaacggtaaacattctgcctaa

SEQ ID NO: 2138 - protein, 259 aa, Neisseria meningitidis
MVSGIVRARGDFVDDQFMRVTDNKHFYRQYADIIQFVRQALRHLPRLLLHVGTQSRGDDGISQDAVFVDVFGRVESLHVVIVQTAYDYGNFTAQIHHFFQNAIHAAVFGKRGFEFIQCFYADLTFAVVAQRSRFQDAGQKLRACFSDVFSLTNHLIRRGLQSRFAYPCLFLNAVLCNRHTIAARGNIGMFCQKAHRIGIDVFKFSGHRRAFCQFVQSSLVVKRRAQMAVGKFCCRRVRIGVENGYFVAHGFGGNGKHSA

SEQ ID NO: 2139 - DNA, 780 bp, Neisseria meningitidis
atggtggccggaattgtgcggacgcggcgcgatttcgttgacgaccaattcatgcgtgtcgccgacaacaaacatttctaccgccaatacgccgacgtagttcaattcatcggccaaacgctgcgccatttgtcgcgcctgttgctgaatgtcggcactcagtcgggctgggacgatggagtaggcgaggataccgttttcgtgaatgttttcggcaggatcgaaagtttgcacgttgtcattgttcagacggcatacgataacggaaatttcgccgcgcaagtccaccattttttccaaaacgcaatccacgccgcggtgttcggcaaacgcggctttgagttcatccaccgttttgacgcggatttggcctttgccgtcatagcccaatgtagcggttttcaggatgccgggcagaaattgtatgctttcttcagtgatgtcttcggctttgcaaattgcttgatacggcgcggtttgcaggcctgctttgcgtatccatgccttttcctgaatgcggttttgcgcgatggcaacgcagtcgccgctgggggaaacattggtatgtttggcgagaaaacgcatcgcatcggcattgacgttttcgaactcggtcgtaacagccgcacattttgccaattcttccaaagcggtttggttgtcaaacggcgcacacaaatggcggtcggcaaattccgctgccggcgcattcgggttgggatcgagtacggttactttgtagcccatggttttggcagcaacagtaaacattctgcctaa

SEQ ID NO: 2140 - protein, 259 aa, Neisseria meningitidis
MVAGIVRTRRDFVDDQFMRVADNKHFYRQYADVVQFIGQTLRHLSRLLLNVGTQSGWDDGVGEDTVFVNVFGRIESLHVVIVQTAYDNGNFAAQVHHFFQNAIHAAVFGKRGFEFIHRFDADLAFAVIAQCSGFQDAGQKLYAFFSDVFGFANCLIRRGLQACFAYPCLFLNAVLRDGNAVAAGGNIGMFGEKTHRIGIDVFELGRNSRTFCQFFQSGLVVKRRTQMAVGKFRCRRIRVGIEYGYFVAHGFGSNSKHSA

SEQ ID NO: 2141 - DNA, 897 bp, Neisseria gonorrhoeae
atgcacatcggcggttattttatcgacaaccccatcgcacttgcgccgatggcgggcattgccgacaaacccttccgccgcctctgtcgggcgtttggcgcaggttgggcggtgtgcgaaatgctggccagcgatccgacgctcaggaataccggaaaaaccctgcaccgcagtgattttgccgatgaaggcggcatcgttgccgtgcagattgccggcagcgaccccgaacagatggcggatgcggcgcgttacaacgtcggactcggggcgcaggtcatcgacatcaatatgggctgccccgccaagaaagtgtgcaacgtccaagccggtagcgcgctgatgcaggacgagccgctggttgccgccattttggaggcggtggtcaaggcggcgggcgtacccgttaccctcaaaacccgtttgggttggcacgacgacgatcaaaacctgcccgccgtcgccaaaatcgccgaagattgcggcattgccgcccttgccgttccacgggcgcgcgcgcacgcaaatgtacaaaggcgaggcgcgttacgaactcatcgccgagaccaaaagccgtctgaacatcccggcctgggtcaacggcgacatcacttcgccgcaaaaagccgccgccgtcctcaaacaaaccgccgccgacggcatcatgatagggcgcggcgcgcaaggcaggccgtggtttttccgcgatttgaagcattatgccgaacacggcgttttaccgcctgccttgagtttggcagaatgcagagccgccattttgaaccacatccgcgccatgcacgcgttttatggtgagaccgtcggtgtgcgcatcgcacgcaaacacataggctggtacatcggcgaaatgcccgacggcgaacaggcgcggcgtga

SEQ ID NO: 2142 - protein, 298 aa, Neisseria gonorrhoeae
  misc_feature (272)..(272): Xaa can be any naturally occurring amino acid
MHIGGYFIDNPIALAPMAGIADKPFRRLCRAFGAGWAVCEMLASDPTLRNTGKTLHRSDFADEGGIVAVQIAGSDPEQMADAARYNVGLGAQVIDINMGCPAKKVCNVQAGSALMQDEPLVAAILEAVVKAAGVPVTLKTRLGWHDDDQNLPAVAKIAEDCGIAALAVPRARAHANVQRRGALRTHRRDQKPSEHPGLGQRRHHFAAKSRRRPQTNRRRRHHDRARRARQAVVFPRFEALCRTRRFTACLEFGRMQSRHFEPHPRHARVLWXDRRCAHRTQTHRLVHRRNARRRTGAA

SEQ ID NO: 2143 - DNA, 896 bp, Neisseria meningitidis
atgcacatcggcggctattttatcgacaaccccatcgcacttgcgccgatggcgggcattaccgacaaaccgttccgccgactttgccgagattttggcgcaggttgggcggtgtgcgaaatgctgaccagcgacccgacgctcagaaatactagaaaaaccttgcaccgcagcgattttgccgatgaaggcggcattgttgccgtgcagattgccggaagcgatccgcagcagatggcggatgccgcgcgttacaacgtcagccttggggcgcagcttatcgacatcaacatgggctgtcccgctaaaaaagtctgcaatgtccaagccggtagcgcgctgatgcagaacgagccgctggttgccgccattttggaagccgtcgtccgtgcggcaggcgtacccgttaccctcaaaacccgtttgggttggcacgacgaccatcaaaacctgcccgtcatcgccaaaatcgccgaagattgcggcatcgccgcccttgccgtccacggacgcacgcgtacgcaaatgtacaaaggcgaagcgcgttacgaactcatcgccgaaaccaaatgccgtctgaacatcccggtctgggtcaacggcgacattacttcgccgcaaaaagcccaagccgtcctcaaacaaaccgccgccgacggcattatgatagggcgcggcgcgcaaggcaggccgtggttcttccgcgatttgaaacattatgccgaacacggtgttttgccgcctgccttgagtttggcagaatgcgccgccgctattttgaaccacatccgcgccatacacgcgttttacggcgacaccgccggtgtgcgcatcgcacgcaaacacataggctggtacatcgacgaaatgcccgacggcgaacagacacgtcgtga

SEQ ID NO: 2144 - protein, 298 aa, Neisseria meningitidis
  misc_feature (169)..(169): Xaa can be any naturally occurring amino acid
MHIGGYFIDNPIALAPMAGITDKPFRRLCRDFGAGWAVCEMLTSDPTLRNTRKTLHRSDFADEGGIVAVQIAGSDPQQMADAARYNVSLGAQLIDINMGCPAKKVCNVQAGSALMQNEPLVAAILEAVVRAAGVPVTLKTRLGWHDDHQNLPVIAKIAEDCGIAALAVXRTHAYANVQRRSALRTHRRNQMPSEHPGLGQRRHYFAAKSPSRPQTNRRRRHYDRARRARQAVVLPRFETLCRTRCFAACLEFGRMRRRYFEPHPRHTRVLRRHRRCAHRTQTHRLVHRRNARRRTDTS

SEQ ID NO: 2145 - DNA, 896 bp, Neisseria meningitidis
atgcacatcggcggctattttatcgacaaccccatcgcacttgcgccgatggcgggcattaccgacaaaccgttccgccgactttgccgagattttggcgcaggttgggcggtgtgcgaaatgctgaccagcgacccgacgctcagaaatactagaaaaaccttgcaccgcagcgattttgccgatgaaggcggcattgttgccgtgcagattgccggaagcgatccgcagcagatggcggatgccgcgcgttacaacgtcagccttggggcgcagcttatcgacatcaacatgggctgtcccgctaaaaaagtctgcaatgtccaagccggtagcgcgctgatgcagaacgagccgctggttgccgccattttggaggcggtggtcaaagcggcgggcgtacccgttaccctcaaaacccgtttgggttggcacgacgaccatcaaaacctgcccgtcatcgccaaaatcgccgaagattgcggcattgccgcccttgccgtccacggacgcacgcgcacgcaaatgtacaaaggcgaagcggcttacgacctgattgccgaaaccaaatgccgtctgaacatcccggtctgggtcaacggcgacattacctcgccgcaaaaagcccaagccgtcctcaaacaaaccgccgcagacggcattatgatagggcgcggcgcgcaaggcagaccgtggttcttccgcgatttgaaacattacgccgaacacggtgttttaccgcctgccttgagtttggcagaatgtaccgccactattttgaaccacatccgagccatgcacgcgttttacggcgacaccgccggtgtgcgcatcgcacgcaaacacataggctggtacatcgacgaaatgcccgacggcgaacagacacgtcgtga

SEQ ID NO: 2146 - protein, 298 aa, Neisseria meningitidis
  misc_feature (168)..(168): Xaa can be any naturally occurring amino acid
MHIGGYFIDNPIALAPMAGITDKPFRRLCRDFGAGWAVCEMLTSDPTLRNTRKTLHRSDFADEGGIVAVQIAGSDPQQMADAARYNVSLGAQLIDINMGCPAKKVCNVQAGSALMQNEPLVAAILEAVVKAAGVPVTLKTRLGWHDDHQNLPVIAKIAEDCGIAALAXPRTHAHANVQRRSGLRPDCRNQMPSEHPGLGQRRHYLAAKSPSRPQTNRRRRHYDRARRARQTVVLPRFETLRRTRCFTACLEFGRMYRHYFEPHPSHARVLRRHRRCAHRTQTHRLVHRRNARRRTDTS

SEQ ID NO: 2147 - DNA, 882 bp, Neisseria gonorrhoeae
atgtgtaccgagatgaaatttatattttttgtactgtatgttttgcagtttctgccgtttgcgctgctgcacaagattgccggcctgatcggttcgcttgcctaccttctggtcaaaccgcgccgccgtatcggcgaaatcaatttggcaaaatgttttcccgaatgggacgaagaaaagcgtaaaaccgtgttgaaacagcatttcaaacacatggcaaaactgatgctcgaatacggcttatattggtacgcgtctgccaaatgcctgaaatcgctggtgcgctaccgcaataagcattatttggacgacgcgctggcggcgggggaaaaagtcatcatcctgtacccgcactttaccgcgttcgagatggcggtgtacgcgcttaatcaggatgtcccgctgatcagtatgtattcccaccaaaaaaacaagatattggacgaacagattttgaaaggccgcaaccgctatcacaacgtcttccttatcgggcgcaccgaagggctgcgcgccctcgtcaaacagttccgcaaaagcagtgcgccgttcctgtatctgcccgatcaggatttcggacgcaacaattcggtttttgtggattttttcggcattcagacggcaacgattaccggcttgagccgcattgccgcgcttgcaaatgcaaaagtgatacccgccattcccgtccgcgaggcggacaatacggttacattgcaattctatcccgcttggaaatcctttccgagtgaagacgcgcaagccgacgcgcaacgtatgaaccgctttatcgaagaacgcgtgcgcgaacacccggaacaatatttctggctgcacaagcgtttcaaaacccgtccggaaggcagccccgatttttactga

SEQ ID NO: 2148 - protein, 293 aa, Neisseria gonorrhoeae
MCTEMKFIFFVLYVLQFLPFALLHKIAGLIGSLAYLLVKPRRRIGEINLAKCFPEWDEEKRKTVLKQHFKHMAKLMLEYGLYWYASAKCLKSLVRYRNKHYLDDALAAGEKVIILYPHFTAFEMAVYALNQDVPLISMYSHQKNKILDEQILKGRNRYHNVFLIGRTEGLRALVKQFRKSSAPFLYLPDQDFGRNNSVFVDFFGIQTATITGLSRIAALANAKVIPAIPVREADNTVTLQFYPAWKSFPSEDAQADAQRMNRFIEERVREHPEQYFWLHKRFKTRPEGSPDFY

SEQ ID NO: 2149 - DNA, 882 bp, Neisseria meningitidis
atgtgtatcgagatgaaatttatattttttgtactgtatgttttgcagtttctgccgtttgcgctgctgcacaagattgccgacctgacgggtttgcttgcctaccttctggtcaaaccgcgccgccgtatcggcgaaatcaatttggcaaaatgtttttccgaatggagtgaggaaaagcgtaaaaccgtgttgaaacagcatttcaaacacatggcgaaactgatgttggaatacggtttatattggtacgcgcctgccggacgtttgaaatcgctggtgcgctaccgcaataagcattatttggacgacgcgctggcggcgggggaaaaagtcatcatcctgtatccgcacttcaccgcgttcgagatggcggtgtacgcgcttaatcaggatatcccgctgatcagtatgtattcccatcaaaaaaacaagatattggacgaacagattttgaaaggccgcaaccgctatcacaacgtcttccttatcgggcgcaccgaagggctgcgcgccctcgtcaaacagttccgcaaaagcagcgcgccgtttctgtatctgcccgatcaggatttcggacgcaacgattcggtttttgtggattttttcggtattcagacggcaacgattaccggattgagccgcattgccgcgcttgcaaatgcaaaagtgatacccgccattcccgtccgcgaggcagacaatacggttacattgcatttctaccctgcttggaaatcctttccgggtgaagacgcgaaagccgacgcgcagcgcatgaaccgttttatcgaagacagggtgcgcgaacatccggaacaatatttttggctgcacaagcgttttaaaacccgtccggaaggcagccccgatttttactga

SEQ ID NO: 2150 - protein, 293 aa, Neisseria meningitidis
MCIEMKFIFFVLYVLQFLPFALLHKIADLTGLLAYLLVKPRRRIGEINLAKCFSEWSEEKRKTVLKQHFKHMAKLMLEYGLYWYAPAGRLKSLVRYRNKHYLDDALAAGEKVIILYPHFTAFEMAVYALNQDIPLISMYSHQKNKILDEQILKGRNRYHNVFLIGRTEGLRALVKQFRKSSAPFLYLPDQDFGRNDSVFVDFFGIQTATITGLSRIAALANAKVIPAIPVREADNTVTLHFYPAWKSFPGEDAKADAQRMNRFIEDRVREHPEQYFWLHKRFKTRPEGSPDFY

SEQ ID NO: 2151 - DNA, 882 bp, Neisseria meningitidis
atgtgtatcgagatgaaatttatattttttgtactgtatgttttgcagtttctgccgtttgcgctgctgcacaaacttgctgatctgacaggcttgctcgcctaccttttggtcaaaccccgccgccgtatcggcgaaatcaatttggcaaaatgctttcccgagtgggacggaaaaaagcgtaaaaccgtgttgaaacagcatttcaaacatatggcgaaactgatgttggaatacggtttatattggtacgcgcccgccgggcgtttgaaatcactggtgcgctaccgcaacaaacattatttggacgacgctctggcggcaggggaaaaagtcatcatcctgtatccgcacttcaccgcgttcgagatggcggtgtacgcgctcaatcaggatgttccgctgatcagtatgtattcccaccaaaaaaacaagatattggacgaacagattttgaaaggccgcaaccgctatcacaacgttttccttatcgggcgcaccgaagggctgcgcgccctcgtcaaacagttccgcaaaagcagcgcgccgtttctgtatctgcccgatcaggatttcggacgcaacgattcggtttttgtcgatttcttcggtattcggacggcaacgattaccggcttgagccgcattgccgcgcttgcaaatgcaaaagtgatacccgccatccctgtccgcgaggcggacaatacggttacattgcatttctaccctgcttgggaatcctttccgagtgaagatgcgcaggccgacgcgcagcgcatgaaccgttttatcgaggaacgcgtgcgcgaacatcccgagcagtatttttggctgcacaagcgtttcaaaacccgtccggaaggcagccccgatttttactga

SEQ ID NO: 2152 - protein, 293 aa, Neisseria meningitidis
MCIEMKFIFFVLYVLQFLPFALLHKLADLTGLLAYLLVKPRRRIGEINLAKCFPEWDGKKRKTVLKQHFKHMAKLMLEYGLYWYAPAGRLKSLVRYRNKHYLDDALAAGEKVIILYPHFTAFEMAVYALNQDVPLISMYSHQKNKILDEQILKGRNRYHNVFLIGRTEGLRALVKQFRKSSAPFLYLPDQDFGRNDSVFVDFFGIRTATITGLSRIAALANAKVIPAIPVREADNTVTLHFYPAWESFPSEDAQADAQRMNRFIEERVREHPEQYFWLHKRFKTRPEGSPDFY

SEQ ID NO: 2153 - DNA, 552 bp, Neisseria gonorrhoeae
atgatacatccgcaccacttccgcgcctttttcataaacggtcatggtgtagaaattgttcatctcctcatagctgacggggcgcaccggatgggcggtcgggcctgcgtcttcggggaactggttctggcgcagcaggcggatgttctcgatgcggcgcacggcgcggccggcgcggtcgccggaaaactcttggtcgcggaacacggtcagcccttccttcagcgaaagctggaaccagtcgcggcaggttacgcggttgcccgtccagttgtggaaatattcgtgtccgaccacggattcaatgccttcgaaatcggtatcggtggcggtgcggctgtcggcgaggacgaacttggtgttaaaaatgttcaaacccttgttttccatcgcgcccatattgaaatcgcctacggcgacgaccatgaaaatatccaagtcatattccaacccgaagcgcgtttcgtcccacttcatcgcgttttttcaacgattccacggcaaagccgaccttgggtttgtccgcttcggtggtgtaaaactcgattttga

SEQ ID NO: 2154 - protein, 183 aa, Neisseria gonorrhoeae
MIHPHHFRAFFINGHGVEIVHLLIADGAHRMGGRACVFGELVLAQQADVLDAAHGAAGAVAGKLLVAEHGQPFLQRKLEPVAAGYAVARPVVEIFVSDHGFNAFEIGIGGGAAVGEDELGVKNVQTLVFHRAHIEIAYGDDHENIQVIFQPEARFVPLHRVFSTIPRQSRPWVCPLRWCKTRF

SEQ ID NO: 2155 - DNA, 551 bp, Neisseria meningitidis
gtgatacatccgcactacttccgcgcctttttcataaacggtcatggtgtagaaattgttcatctcctcatagctggcggggcgcaccggatgggcggtcgggcctgcgtcttcggggaactggtgctggcgcagcaggcggatgttttcgatgcggcgcacggcgcggctggcgcggtcgccggaaaattcttggtcgcggaacacggtcagcccttccttcagcgaaagctggaaccagtcgcggcaggttacgcggttgcccgtccagttgtggaaatactcgtgtccgaccacggattcgatgccttcgaaatcggtatcggtggcggtgcggctgtcggcaaggacgaacttggtgttaaagatgttcaaacccttgttttccatcgcgcccatattgaaatcgcccacggcgacgaccatgaaaatatccaagtcgtattccaaaccgaagcgcgtttcgtcccatttcatcgcgtttttcaacgattccacggcaaagccgaccttgggcttgtccgcttcggtggtgtaaaactcgattttga

SEQ ID NO: 2156 - protein, 183 aa, Neisseria meningitidis
  misc_feature (163)..(163): Xaa can be any naturally occurring amino acid
VIHPHYFRAFFINGHGVEIVHLLIAGGAHRMGGRACVFGELVLAQQADVFDAAHGAAGAVAGKFLVAEHGQPFLQRKLEPVAAGYAVARPVVEILVSDHGFDAFEIGIGGGAAVGKDELGVKDVQTLVFHRAHIEIAHGDDHENIQVVFQTEARFVPFHRVFXTIPRQSRPWACPLRWCKTRF

SEQ ID NO: 2157 - DNA, 551 bp, Neisseria meningitidis
gtgatacatccgcaccacttccgcgcctttttcataaacggtcatggtgtagaaattgttcatctcctcatatcgggcggggcgcaccggatgtgcggtcggacctgcgtcttcggggaactggtgctggcgcagcaggcggatgttttcgatacggcgcacggcgcggctggcgcggtcgccggaaaattcttggtcgcggaacacggtcaacccttccttcagcgaaagctggaaccagtcgcggcaggtcacgcggttgcccgtccagttgtggaaatattcgtgtccgaccacggattcgatgccttcaaaatcggtatcggtggcggtacggctgtcggcaaggacgaacttggtgttaaagatgttcaaacccttgttttccatcgcacccatattgaaatcgcccacggcgacgaccatgaaaatatccaagtcgtattccaaaccgaagcgcgtttcgtcccacttcattgcgtttttcagcgattccacggcaaagccgaccttgggcttgtccgcttcggtggtgtaaaactcgattttga

SEQ ID NO: 2158 - protein, 183 aa, Neisseria meningitidis
  misc_feature (163)..(163): Xaa can be any naturally occurring amino acid
VIHPHHFRAFFINGHGVEIVHLLISGGAHRMCGRTCVFGELVLAQQADVFDTAHGAAGAVAGKFLVAEHGQPFLQRKLEPVAAGHAVARPVVEIFVSDHGFDAFKIGIGGGTAVGKDELGVKDVQTLVFHRTHIEIAHGDDHENIQVVFQTEARFVPLHCVFXAIPRQSRPWACPLRWCKTRF

SEQ ID NO: 2159 - DNA, 1917 bp, Neisseria gonorrhoeae
atgaagtgggacgaaacgcgcttcgggttggaatatgacttggatattttcatggtcgtcgccgtaggcgatttcaatatgggcgcgatggaaaacaagggtttgaacatttttaacaccaagttcgtcctcgccgacagccgcaccgccaccgataccgatttcgaaggcattgaatccgtggtcggacacgaatatttccacaactggacgggcaaccgcgtaacctgccgcgactggttccagctttcgctgaaggaagggctgaccgtgttccgcgaccaagagttttccggcgaccgcgccggccgcgccgtgcgccgcatcgagaacatccgcctgctgcgccagaaccagttccccgaagacgcaggcccgaccgcccatccggtgcgccccgtcagctatgaggagatgaacaatttctacaccatgaccgtttatgaaaaaggcgcggaagtggtgcggatgtatcataccctgctcggcgaagagggcttccaaaaaggcatgaagctatatttccaacgccacgacggacaggcagtgacctgcgacgatttccgcgcggcgatggcggatgcgaacggcatcaatctcgaccagttcgccttgtggtacagccaggcgggcacgcccgttttggaagccgaaggccgtctgaaaaacaatgttttcgagttaaccattaaacaaaccgtgccgcccacgcccgatatggcggacaaacagccgatgatgattcccgtcaaagtcgggcttctgaaccgcaacggcgaagcggtggcattcgattatcagggcaaacgcgcaaccgaagccgtgttgctgatgaccgaagccgaacaggccttcccgctcgaaggtgtaaccgaagccgtcgttccctcgctgctgcgcgggttcagcgcgccagtgtatctgaactatccgtacagcgacgacgacctgctgctcctgctcgcccacgacagcgacgctttcacgtgctgggaagccgcccaaacgctctaccgtcgcgccgtcgccgccaaccttgccgcgctttcagacggcatcgggttgccgaaacacgaaaaactgcttgccgccgtcgaaaaagtcatttcagacgacctcttggacaacgccttcaaagccctgcttttgggcgtgccgtccgaagccgaactgtgggacggcacggaaaacatcgacccgctgcgctaccatcaggcgcgcgaagccttgttggatacgcttgccgtccgcttcctgccgaaatggcacgaattggaccgtcaggcggcgaagcaggaaaaccaaagttacgaatacagccccgaaaccgccgactggcgcacgctgcgcaacgtctgccgcgccttcgtcctgcgcgccgaccccgcgcacatcgaaactgttgccgaaaaatacggcgaaatggcgcaaaacatgacccacgaatggggcatcctgtccgccgtcaacggcaacgaaagcgatacgcgcaactgcctgctggcgcagtttgccgacaagttttcagacgacgcgctggtgatggacaaatatttcgcccttatcggctcaagccgccgcagcgacaccctgcaacaggttcaaaccgccttgcagcatccgaaattcagtctcgaaaaccccaacaaagcccgttcgctcatcggcagcttcagccgcaacgtcccgcattttcacgcacaagacggcagcggctaccgcttcatcgccgacaaagtcatcgaaatcgaccgcttcaacccgcaggtcgccgcccgcctggtgcaggcgttcaacctctgcaacaagctcgagccgcaccgcaaaaacttggtgaaacaagaattgcagtgcattcgggcgcaggaaggattgtcgaaagacgtgggcgaaatcgtcggcaagattttgggttga

SEQ ID NO: 2160 - protein, 638 aa, Neisseria gonorrhoeae
MKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRAGRAVRRIENIRLLRQNQFPEDAGPTAHPVRPVSYEEMNNFYTMTVYEKGAEVVRMYHTLLGEEGFQKGMKLYFQRHDGQAVTCDDFRAAMADANGINLDQFALWYSQAGTPVLEAEGRLKNNVFELTIKQTVPPTPDMADKQPMMIPVKVGLLNRNGEAVAFDYQGKRATEAVLLMTEAEQAFPLEGVTEAVVPSLLRGFSAPVYLNYPYSDDDLLLLLAHDSDAFTCWEAAQTLYRRAVAANLAALSDGIGLPKHEKLLAAVEKVISDDLLDNAFKALLLGVPSEAELWDGTENIDPLRYHQAREALLDTLAVRFLPKWHELDRQAAKQENQSYEYSPETADWRTLRNVCRAFVLRADPAHIETVAEKYGEMAQNMTHEWGILSAVNGNESDTRNCLLAQFADKFSDDALVMDKYFALIGSSRRSDTLQQVQTALQHPKFSLENPNKARSLIGSFSRNVPHFHAQDGSGYRFIADKVIEIDRFNPQVAARLVQAFNLCNKLEPHRKNLVKQELQCIRAQEGLSKDVGEIVGKILG

SEQ ID NO: 2161 - DNA, 1917 bp, Neisseria meningitidis
atgaaatgggacgaaacgcgcttcggtttggaatacgacttggatattttcatggtcgtcgccgtgggcgatttcaatatgggcgcgatggaaaacaagggtttgaacatctttaacaccaagttcgtccttgccgacagccgcaccgccaccgataccgatttcgaaggcatcgaatccgtggtcggacacgagtatttccacaactggacgggcaaccgcgtaacctgccgcgactggttccagctttcgctgaaggaagggctgaccgtgttccgcgaccaagaattttccggcgaccgcgccagccgcgccgtgcgccgcatcgaaaacatccgcctgctgcgccagcaccagttccccgaagacgcaggcccgaccgcccatccggtgcgccccgccagctatgaggagatgaacaatttctacaccatgaccgtttatgaaaaaggcgcggaagtagtgcggatgtatcacaccctgctcggcgaagagggcttccagaaaggcatgaagctctatttccaacgccacgacggacaggccgttacctgcgacgatttccgcgcggcgatggcggacgcgaacggcatcaatctcgaccagttcgccttgtggtacagccaggcgggcacgcccgttttggaagcggaaggtcgtctgaaaaacaatattttcgagttgaccgtcaaacaaaccgtgccgcccacgcccgatatgacggataaacagccgatgatgattcccgtcaaggtcgggctgctgaaccgcaacggcgaagcggtggcattcgactatcagggcaaacgcgcgaccgaagccgtgttgctgctgaccgaagccgaacagaccttcctgctcgaaggcgtaaccgaagccgtcgttccctcgctgctgcgcgggttcagcgcgccggtgcatctgaactatccgtacagcgacgacgacctgctgctcctgctcgcccatgacagcgacgccttcacgcgctgggaagccgcccaaacgctctaccgccgcgccgtcgccgccaaccttgccacgctttcagacggcgttgagctgccgaaacacgaaaaactgcttgccgccgtcgaaaaagtcatttcagacgacctcttagacaacgccttcaaagccctgcttttgggcgtgccatccgaagccgagctgtgggacggcgcagaaaacatcgacccgctgcgctaccatcaggcgcgcgaagccttgttggatacgcttgccgtccacttcctgccgaaatggcacgaattgaaccgtcaggcggcgaagcaggaaaaccaaagctacgaatacagccccgaagccgccggctggcgcacgctgcgcaacgtctgccgcgcctttgtcctgcgcgccgaccccgcgcacatcgaaaccgttgccgaaaaatacggcgaaatggcgcaaaacatgacccacgaatggggcatcctgtccgccgtcaacggcaacgaaagcgatacgcgcaaccgcctgctggcgcagtttgccgacaagttttcagacgacgcgctggtgatggacaaatattttgccctcgtcggctcaagccgccgcagcgacaccctgcaacaggttcgaaccgccttgcagcatccgaaattcagcctcgaaaaccccaacaaagcccgttcgctcatcggcagcttcagccgcaacgtcccgcatttccacgcagaagacggcagcggctaccgcttcatcgccgacaaagtcatcgaaatcgaccgcttcaacccgcaggtcgccgcccgcttagtgcaggcgttcaacctctgcaacaagctcgagccgcaccgcaaaaacttggtgaaacaagcattgcagcgcattcgggcgcaggaaggattgtcgaaagacgtgggcgaaatcgtcggcaaaattttggattga

SEQ ID NO: 2162 - protein, 638 aa, Neisseria meningitidis
MKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRASRAVRRIENIRLLRQHQFPEDAGPTAHPVRPASYEEMNNFYTMTVYEKGAEVVRMYHTLLGEEGFQKGMKLYFQRHDGQAVTCDDFRAAMADANGINLDQFALWYSQAGTPVLEAEGRLKNNIFELTVKQTVPPTPDMTDKQPMMIPVKVGLLNRNGEAVAFDYQGKRATEAVLLLTEAEQTFLLEGVTEAVVPSLLRGFSAPVHLNYPYSDDDLLLLLAHDSDAFTRWEAAQTLYRRAVAANLATLSDGVELPKHEKLLAAVEKVISDDLLDNAFKALLLGVPSEAELWDGAENIDPLRYHQAREALLDTLAVHFLPKWHELNRQAAKQENQSYEYSPEAAGWRTLRNVCRAFVLRADPAHIETVAEKYGEMAQNMTHEWGILSAVNGNESDTRNRLLAQFADKFSDDALVMDKYFALVGSSRRSDTLQQVRTALQHPKFSLENPNKARSLIGSFSRNVPHFHAEDGSGYRFIADKVIEIDRFNPQVAARLVQAFNLCNKLEPHRKNLVKQALQRIRAQEGLSKDVGEIVGKILD

SEQ ID NO: 2163 - DNA, 1917 bp, Neisseria meningitidis
atgaagtgggacgaaacgcgcttcggtttggaatacgacttggatattttcatggtcgtcgccgtgggcgatttcaatatgggtgcgatggaaaacaagggtttgaacatctttaacaccaagttcgtccttgccgacagccgtaccgccaccgataccgattttgaaggcatcgaatccgtggtcggacacgaatatttccacaactggacgggcaaccgcgtgacctgccgcgactggttccagctttcgctgaaggaagggttgaccgtgttccgcgaccaagaattttccggcgaccgcgccagccgcgccgtgcgccgtatcgaaaacatccgcctgctgcgccagcaccagttccccgaagacgcaggtccgaccgcacatccggtgcgccccgcccgatatgaggagatgaacaatttctacaccatgaccgtttatgaaaaaggcgcggaagtggtgcggatgtatcacaccttgctcggcgaagagggcttccaaaaaggtatgaagctctatttccaacgccacgacggacaggctgttacctgcgacgatttccgcgcggcgatggtggacgcgaacggcatcaacctcgaccaattcgccttgtggtacagccaagcaggtacgccggttttagatgctcaagggcgtctgaaaaacaatgtgttcgagttaaccatcaaacaaaccgtgccgcccacgcccgatatggcggacaaacagccgatgatgattcccgtcaaaatcgggctgctgaactgcaacggcgaagcggtggcatttgattatcagggcaaacgcgcgaccgaagccgtgttgctgctgaccgaagccgaacagaccttccagttcgaaagcgtaaccgaagccgtcgttccctcgctgctgcgcgggttcagcgcgccggtgcatctgaactatccgtacagcgacgacgacctgctgcttctgctcgcccatgacagcgacgccttcacgcgctgggaagccgcacaaacgctctaccgccgtgccgtcgccgccaaccttgccgcgctttcagacggcgtcgagttgccgaaacacgaaaaactgcttgccgccgtcgaaaaagtcatttcagacgacctcttagacaacgctttcaaagccctgcttttgggtgtgccgtctgaagccgagctgtgggacggcgcggaaaacatcgacccgctgcgctaccatcaggcgcgcgaagccttgttggatatacttgccgtccgctttctgccgaaatggcacgaattgaaccgtcaggcggcgaagcaggaaaaccaaagctacgagtacagccccgaagccgccggttggcgcacgctgcgcaatgtctgccgcgccttcgtcctgcgcgccgatcccgcgcacatcgaaaccgttgccgagaaatacgccgaaatggcgcaaaacatgacccacgaatggggcatcctgtccgccgtcaacggcaacgaaagcgatacgcgcaaccgcctgctggcgcagtttgccgacaagttttcagacgacgcgctggtgatggacaaatatttcgccctcgtcggctcaagccgccgcagcgacaccctgcaacaggttcaaaccgccttgcagcatccgaagttcagcctcgaaaatcccaacaaagcccgctcgctcatcggcagcttcagccgcaacgtcccgcatttccacgcagaagacggcagcggctaccgcttcatcgccgacaaagtcatcgaaatcgaccgctttaacccgcaggtcgccgcccgcctggtgcaggcgttcaacctctgcaacaagctcgagccgcaccgcaaaaacttggtgaaacaagcattgcagcgcattcgggcgcaggaaggattgtcgaaagacgtgggcgaaatcgtcggcaaaattttggattga

SEQ ID NO: 2164 - protein, 638 aa, Neisseria meningitidis
MKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRASRAVRRIENIRLLRQHQFPEDAGPTAHPVRPARYEEMNNFYTMTVYEKGAEVVRMYHTLLGEEGFQKGMKLYFQRHDGQAVTCDDFRAAMVDANGINLDQFALWYSQAGTPVLDAQGRLKNNVFELTIKQTVPPTPDMADKQPMMIPVKIGLLNCNGEAVAFDYQGKRATEAVLLLTEAEQTFQFESVTEAVVPSLLRGFSAPVHLNYPYSDDDLLLLLAHDSDAFTRWEAAQTLYRRAVAANLAALSDGVELPKHEKLLAAVEKVISDDLLDNAFKALLLGVPSEAELWDGAENIDPLRYHQAREALLDILAVRFLPKWHELNRQAAKQENQSYEYSPEAAGWRTLRNVCRAFVLRADPAHIETVAEKYAEMAQNMTHEWGILSAVNGNESDTRNRLLAQFADKFSDDALVMDKYFALVGSSRRSDTLQQVQTALQHPKFSLENPNKARSLIGSFSRNVPHFHAEDGSGYRFIADKVIEIDRFNPQVAARLVQAFNLCNKLEPHRKNLVKQALQRIRAQEGLSKDVGEIVGKILD

SEQ ID NO: 2165 - DNA, 2604 bp, Neisseria gonorrhoeae
atgagcaaaaccgtccgttatctgaaagattaccaaacgcctgcctaccgcattcttgaaaccgaactgcatttcgacattgccgaaccgcaaaccgtcgtgaagtcgcgtttgacggtcgagccgcagagggcgggcgagccgctggtgttggacggttcggcaaaactcttgtccgtcaaaatcaacggcgcggcggcggattatgtgttggaaggcgagacgctgacgattgcagacgtaccgtccgaacgcttcaccgtcgaagtggaaaccgaaatcctgccggcggaaaacaaatcgctgatggggctgtatgcttccggcggcaatctgtttacccagtgcgagccggagggcttccgcaaaatcacgttctacatcgaccgtccggatgtgatgtccaagttcacgaccaccatcgtcgcggacaaaaaacgctatcccgttttgctttccaacggcaacaaaatcgacggcggcgagttttcagacggccgccattgggtgaaatgggaagacccgtttgccaaaccgagttatctgtttgctttggtcgcgggcgatttggcggtaacggaagaccgtttcaccaccatgagcggcagaaacgtcaaaatcgagttttacaccaccgaagcggacaaacccaaggtcggctttgccgtggaatcgttgaaaaacgcgatgaagtgggacgaaacgcgcttcgggttggaatatgacttggatattttcatggtcgtcgccgtaggcgatttcaatatgggcgcgatggaaaacaagggtttgaacatttttaacaccaagttcgtcctcgccgacagccgcaccgccaccgataccgatttcgaaggcattgaatccgtggtcggacacgaatatttccacaactggacgggcaaccgcgtaacctgccgcgactggttccagctttcgctgaaggaagggctgaccgtgttccgcgaccaagagttttccggcgaccgcgccggccgcgccgtgcgccgcatcgagaacatccgcctgctgcgccagaaccagttccccgaagacgcaggcccgaccgcccatccggtgcgccccgtcagctatgaggagatgaacaatttctacaccatgaccgtttatgaaaaaggcgcggaagtggtgcggatgtatcataccctgctcggcgaagagggcttccaaaaaggcatgaagctatatttccaacgccacgacggacaggcagtgacctgcgacgatttccgcgcggcgatggcggatgcgaacggcatcaatctcgaccagttcgccttgtggtacagccaggcgggcacgcccgttttggaagccgaaggccgtctgaaaaacaatgttttcgagttaaccattaaacaaaccgtgccgcccacgcccgatatggcggacaaacagccgatgatgattcccgtcaaagtcgggcttctgaaccgcaacggcgaagcggtggcattcgattatcagggcaaacgcgcaaccgaagccgtgttgctgatgaccgaagccgaacaggccttcccgctcgaaggtgtaaccgaagccgtcgttccctcgctgctgcgcgggttcagcgcgccagtgtatctgaactatccgtacagcgacgacgacctgctgctcctgctcgcccacgacagcgacgctttcacgtgctgggaagccgcccaaacgctctaccgtcgcgccgtcgccgccaaccttgccgcgctttcagacggcatcgggttgccgaaacacgaaaaactgcttgccgccgtcgaaaaagtcatttcagacgacctcttggacaacgccttcaaagccctgcttttgggcgtgccgtccgaagccgaactgtgggacggcacggaaaacatcgacccgctgcgctaccatcaggcgcgcgaagccttgttggatacgcttgccgtccgcttcctgccgaaatggcacgaattggaccgtcaggcggcgaagcaggaaaaccaaagttacgaatacagccccgaaaccgccgactggcgcacgctgcgcaacgtctgccgcgccttcgtcctgcgcgccgaccccgcgcacatcgaaactgttgccgaaaaatacggcgaaatggcgcaaaacatgacccacgaatggggcatcctgtccgccgtcaacggcaacgaaagcgatacgcgcaactgcctgctggcgcagtttgccgacaagttttcagacgacgcgctggtgatggacaaatatttcgcccttatcggctcaagccgccgcagcgacaccctgcaacaggttcaaaccgccttgcagcatccgaaattcagtctcgaaaaccccaacaaagcccgttcgctcatcggcagcttcagccgcaacgtcccgcattttcacgcacaagacggcagcggctaccgcttcatcgccgacaaagtcatcgaaatcgaccgcttcaacccgcaggtcgccgcccgcctggtgcaggcgttcaacctctgcaacaagctcgagccgcaccgcaaaaacttggtgaaacaagaattgcagtgcattcgggcgcaggaaggattgtcgaaagacgtgggcgaaatcgtcggcaagattttgggttga

SEQ ID NO: 2166 - protein, 867 aa, Neisseria gonorrhoeae
MSKTVRYLKDYQTPAYRILETELHFDIAEPQTVVKSRLTVEPQRAGEPLVLDGSAKLLSVKINGAAADYVLEGETLTIADVPSERFTVEVETEILPAENKSLMGLYASGGNLFTQCEPEGFRKITFYIDRPDVMSKFTTTIVADKKRYPVLLSNGNKIDGGEFSDGRHWVKWEDPFAKPSYLFALVAGDLAVTEDRFTTMSGRNVKIEFYTTEADKPKVGFAVESLKNAMKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRAGRAVRRIENIRLLRQNQFPEDAGPTAHPVRPVSYEEMNNFYTMTVYEKGAEVVRMYHTLLGEEGFQKGMKLYFQRHDGQAVTCDDFRAAMADANGINLDQFALWYSQAGTPVLEAEGRLKNNVFELTIKQTVPPTPDMADKQPMMIPVKVGLLNRNGEAVAFDYQGKRATEAVLLMTEAEQAFPLEGVTEAVVPSLLRGFSAPVYLNYPYSDDDLLLLLAHDSDAFTCWEAAQTLYRRAVAANLAALSDGIGLPKHEKLLAAVEKVISDDLLDNAFKALLLGVPSEAELWDGTENIDPLRYHQAREALLDTLAVRFLPKWHELDRQAAKQENQSYEYSPETADWRTLRNVCRAFVLRADPAHIETVAEKYGEMAQNMTHEWGILSAVNGNESDTRNCLLAQFADKFSDDALVMDKYFALIGSSRRSDTLQQVQTALQHPKFSLENPNKARSLIGSFSRNVPHFHAQDGSGYRFIADKVIEIDRFNPQVAARLVQAFNLCNKLEPHRKNLVKQELQCIRAQEGLSKDVGEIVGKILG

SEQ ID NO: 2167 - DNA, 2604 bp, Neisseria meningitidis
atgagcaaaaccgtgcattatctcaaagactatcaaacgcccgcctaccatattctcaaaaccgatttacattttgatattaatgaaccgcaaaccgtcgtgaagtcgcgtttgacggttgagccgcagagggtaggggagccgctggtgttggacggttcggcgaaactcttgtccgtcaaaatcaacggggcggcggcggattatgtgttggaaggagagacgctgacgattgcgggcgtgccgtccgaacgcttcaccgtcgaagtggaaaccgaaatcctgccggcggaaaacaaatcgctgatggggctgtatgcttccggcggcaatttgtttacccagtgcgagccggagggcttccgcaaaatcacattttacatcgaccgtccggatgtgatgtccaagttcaccaccaccatcgtcgccgacaaaaaacgctatcccgttttgctttccaacggcaacaaaatcgacggcggcgagttttcagacggccgccattgggtgaaatgggaagacccgttttccaaaccgagctatctgtttgctttggtcgcgggcgatttggcggtaacggaagactatttcaccaccatgagcggcagaaacgtcaaaatcgagttttacaccaccgaagcggacaagcccaaggtcggctttgccgtggaatcgttgaaaaacgcgatgaaatgggacgaaacgcgcttcggtttggaatacgacttggatattttcatggtcgtcgccgtgggcgatttcaatatgggcgcgatggaaaacaagggtttgaacatctttaacaccaagttcgtccttgccgacagccgcaccgccaccgataccgatttcgaaggcatcgaatccgtggtcggacacgagtatttccacaactggacgggcaaccgcgtaacctgccgcgactggttccagctttcgctgaaggaagggctgaccgtgttccgcgaccaagaattttccggcgaccgcgccagccgcgccgtgcgccgcatcgaaaacatccgcctgctgcgccagcaccagttccccgaagacgcaggcccgaccgcccatccggtgcgccccgccagctatgaggagatgaacaatttctacaccatgaccgtttatgaaaaaggcgcggaagtagtgcggatgtatcacaccctgctcggcgaagagggcttccagaaaggcatgaagctctatttccaacgccacgacggacaggccgttacctgcgacgatttccgcgcggcgatggcggacgcgaacggcatcaatctcgaccagttcgccttgtggtacagccaggcgggcacgcccgttttggaagcggaaggtcgtctgaaaaacaatattttcgagttgaccgtcaaacaaaccgtgccgcccacgcccgatatgacggataaacagccgatgatgattcccgtcaaggtcgggctgctgaaccgcaacggcgaagcggtggcattcgactatcagggcaaacgcgcgaccgaagccgtgttgctgctgaccgaagccgaacagaccttcctgctcgaaggcgtaaccgaagccgtcgttccctcgctgctgcgcgggttcagcgcgccggtgcatctgaactatccgtacagcgacgacgacctgctgctcctgctcgcccatgacagcgacgccttcacgcgctgggaagccgcccaaacgctctaccgccgcgccgtcgccgccaaccttgccacgctttcagacggcgttgagctgccgaaacacgaaaaactgcttgccgccgtcgaaaaagtcatttcagacgacctcttagacaacgccttcaaagccctgcttttgggcgtgccatccgaagccgagctgtgggacggcgcagaaaacatcgacccgctgcgctaccatcaggcgcgcgaagccttgttggatacgcttgccgtccacttcctgccgaaatggcacgaattgaaccgtcaggcggcgaagcaggaaaaccaaagctacgaatacagccccgaagccgccggctggcgcacgctgcgcaacgtctgccgcgcctttgtcctgcgcgccgaccccgcgcacatcgaaaccgttgccgaaaaatacggcgaaatggcgcaaaacatgacccacgaatggggcatcctgtccgccgtcaacggcaacgaaagcgatacgcgcaaccgcctgctggcgcagtttgccgacaagttttcagacgacgcgctggtgatggacaaatattttgccctcgtcggctcaagccgccgcagcgacaccctgcaacaggttcgaaccgccttgcagcatccgaaattcagcctcgaaaaccccaacaaagcccgttcgctcatcggcagcttcagccgcaacgtcccgcatttccacgcagaagacggcagcggctaccgcttcatcgccgacaaagtcatcgaaatcgaccgcttcaacccgcaggtcgccgcccgcttagtgcaggcgttcaacctctgcaacaagctcgagccgcaccgcaaaaacttggtgaaacaagcattgcagcgcattcgggcgcaggaaggattgtcgaaagacgtgggcgaaatcgtcggcaaaattttggattga

SEQ ID NO: 2168 - protein, 867 aa, Neisseria meningitidis
MSKTVHYLKDYQTPAYHILKTDLHFDINEPQTVVKSRLTVEPQRVGEPLVLDGSAKLLSVKINGAAADYVLEGETLTIAGVPSERFTVEVETEILPAENKSLMGLYASGGNLFTQCEPEGFRKITFYIDRPDVMSKFTTTIVADKKRYPVLLSNGNKIDGGEFSDGRHWVKWEDPFSKPSYLFALVAGDLAVTEDYFTTMSGRNVKIEFYTTEADKPKVGFAVESLKNAMKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRASRAVRRIENIRLLRQHQFPEDAGPTAHPVRPASYEEMNNFYTMTVYEKGAEVVRMYHTLLGEEGFQKGMKLYFQRHDGQAVTCDDFRAAMADANGINLDQFALWYSQAGTPVLEAEGRLKNNIFELTVKQTVPPTPDMTDKQPMMIPVKVGLLNRNGEAVAFDYQGKRATEAVLLLTEAEQTFLLEGVTEAVVPSLLRGFSAPVHLNYPYSDDDLLLLLAHDSDAFTRWEAAQTLYRRAVAANLATLSDGVELPKHEKLLAAVEKVISDDLLDNAFKALLLGVPSEAELWDGAENIDPLRYHQAREALLDTLAVHFLPKWHELNRQAAKQENQSYEYSPEAAGWRTLRNVCRAFVLRADPAHIETVAEKYGEMAQNMTHEWGILSAVNGNESDTRNRLLAQFADKFSDDALVMDKYFALVGSSRRSDTLQQVRTALQHPKFSLENPNKARSLIGSFSRNVPHFHAEDGSGYRFIADKVIEIDRFNPQVAARLVQAFNLCNKLEPHRKNLVKQALQRIRAQEGLSKDVGEIVGKILD

SEQ ID NO: 2169 - DNA, 2604 bp, Neisseria meningitidis
atgagcaaaaccgtgcattatctcaaagactatcaaacgcccgcctaccatattctcaaaaccgatttacattttgatattaacgaaccgcaaaccattgtgaagtcgcgtttgacggtcgagccgaagagggtgggagagccgctggtgttggacggttcggcgaaactcttgtccgtcaaaatcaacggcgtggcggcggattatgtgttggaaggcgagacgctgacgattgcggacgtgccgtccgaacgcttcaccgtcgaagtggaaaccgaaatcctgccggcggaaaacaaatcgctgatggggctgtatgcgtccgccggtaacctgtttacccagtgcgagccggagggcttccgcaaaatcacgttctatatcgaccgtccggatgtcatgtccaagttcacgaccaccatcgtcgcggacaaaaaacgctatcccgttttgctctccaacggcaacaaaatcgacggcggcgagtattcagacggccgccattgggtgaaatgggaagacccgtttgccaaaccgagttatctgtttgctttggtcgcgggcgatttggcggtcacggaagactatttcaccaccatgagcggcagaaacgtcaaaatcgagttttacaccaccgaagcggacaagcccaaggtcggctttgccgtggaatcgctgaaaaacgcaatgaagtgggacgaaacgcgcttcggtttggaatacgacttggatattttcatggtcgtcgccgtgggcgatttcaatatgggtgcgatggaaaacaagggtttgaacatctttaacaccaagttcgtccttgccgacagccgtaccgccaccgataccgattttgaaggcatcgaatccgtggtcggacacgaatatttccacaactggacgggcaaccgcgtgacctgccgcgactggttccagctttcgctgaaggaagggttgaccgtgttccgcgaccaagaattttccggcgaccgcgccagccgcgccgtgcgccgtatcgaaaacatccgcctgctgcgccagcaccagttccccgaagacgcaggtccgaccgcacatccggtgcgccccgcccgatatgaggagatgaacaatttctacaccatgaccgtttatgaaaaaggcgcggaagtggtgcggatgtatcacaccttgctcggcgaagagggcttccaaaaaggtatgaagctctatttccaacgccacgacggacaggctgttacctgcgacgatttccgcgcggcgatggtggacgcgaacggcatcaacctcgaccaattcgccttgtggtacagccaagcaggtacgccggttttagatgctcaagggcgtctgaaaaacaatgtgttcgagttaaccatcaaacaaaccgtgccgcccacgcccgatatggcggacaaacagccgatgatgattcccgtcaaaatcgggctgctgaactgcaacggcgaagcggtggcatttgattatcagggcaaacgcgcgaccgaagccgtgttgctgctgaccgaagccgaacagaccttccagttcgaaagcgtaaccgaagccgtcgttccctcgctgctgcgcgggttcagcgcgccggtgcatctgaactatccgtacagcgacgacgacctgctgcttctgctcgcccatgacagcgacgccttcacgcgctgggaagccgcacaaacgctctaccgccgtgccgtcgccgccaaccttgccgcgctttcagacggcgtcgagttgccgaaacacgaaaaactgcttgccgccgtcgaaaaagtcatttcagacgacctcttagacaacgctttcaaagccctgcttttgggtgtgccgtctgaagccgagctgtgggacggcgcggaaaacatcgacccgctgcgctaccatcaggcgcgcgaagccttgttggatatacttgccgtccgctttctgccgaaatggcacgaattgaaccgtcaggcggcgaagcaggaaaaccaaagctacgagtacagccccgaagccgccggttggcgcacgctgcgcaatgtctgccgcgccttcgtcctgcgcgccgatcccgcgcacatcgaaaccgttgccgagaaatacgccgaaatggcgcaaaacatgacccacgaatggggcatcctgtccgccgtcaacggcaacgaaagcgatacgcgcaaccgcctgctggcgcagtttgccgacaagttttcagacgacgcgctggtgatggacaaatatttcgccctcgtcggctcaagccgccgcagcgacaccctgcaacaggttcaaaccgccttgcagcatccgaagttcagcctcgaaaatcccaacaaagcccgctcgctcatcggcagcttcagccgcaacgtcccgcatttccacgcagaagacggcagcggctaccgcttcatcgccgacaaagtcatcgaaatcgaccgctttaacccgcaggtcgccgcccgcctggtgcaggcgttcaacctctgcaacaagctcgagccgcaccgcaaaaacttggtgaaacaagcattgcagcgcattcgggcgcaggaaggattgtcgaaagacgtgggcgaaatcgtcggcaaaattttggattga

SEQ ID NO: 2170 - protein, 867 aa, Neisseria meningitidis
MSKTVHYLKDYQTPAYHILKTDLHFDINEPQTIVKSRLTVEPKRVGEPLVLDGSAKLLSVKINGVAADYVLEGETLTIADVPSERFTVEVETEILPAENKSLMGLYASAGNLFTQCEPEGFRKITFYIDRPDVMSKFTTTIVADKKRYPVLLSNGNKIDGGEYSDGRHWVKWEDPFAKPSYLFALVAGDLAVTEDYFTTMSGRNVKIEFYTTEADKPKVGFAVESLKNAMKWDETRFGLEYDLDIFMVVAVGDFNMGAMENKGLNIFNTKFVLADSRTATDTDFEGIESVVGHEYFHNWTGNRVTCRDWFQLSLKEGLTVFRDQEFSGDRASRAVRRIENIRLLRQHQFPEDAGPTAHPVRPARYEEMNNFYTMTVYEKGAEVVRMYHTLLGEEGFQKGMKLYFQRHDGQAVTCDDFRAAMVDANGINLDQFALWYSQAGTPVLDAQGRLKNNVFELTIKQTVPPTPDMADKQPMMIPVKIGLLNCNGEAVAFDYQGKRATEAVLLLTEAEQTFQFESVTEAVVPSLLRGFSAPVHLNYPYSDDDLLLLLAHDSDAFTRWEAAQTLYRRAVAANLAALSDGVELPKHEKLLAAVEKVISDDLLDNAFKALLLGVPSEAELWDGAENIDPLRYHQAREALLDILAVRFLPKWHELNRQAAKQENQSYEYSPEAAGWRTLRNVCRAFVLRADPAHIETVAEKYAEMAQNMTHEWGILSAVNGNESDTRNRLLAQFADKFSDDALVMDKYFALVGSSRRSDTLQQVQTALQHPKFSLENPNKARSLIGSFSRNVPHFHAEDGSGYRFIADKVIEIDRFNPQVAARLVQAFNLCNKLEPHRKNLVKQALQRIRAQEGLSKDVGEIVGKILD

SEQ ID NO: 2171 - DNA, 540 bp, Neisseria gonorrhoeae
atgctttgtatgaattatcaatcaaactcaggcgaaggagtgcttgtagctaaaacatatttattgactgcattgataatgtctatggtaatctccggatgtcaagtcatccatgccaatcaaggtaaggttaatactaattctgctgtcatcgcaggtgcagacgctcacacgcctgaacatgtaacgggactgaccgaacaaaagcaggtgattgcaagtgattttatagtagcgtcagccaatccattagcaacacaagctggctatgatatcttaaagcaaggcggtagcgctgcagatgcgatggtggcggtgcagacgacactaagcttggtagagccacagtcgtcaggcttgggcggtggtgcatttgtgttgtattgggacaataccgccaaaacattgaccacatttgatgggcgtgagacggcaccgatgcgtgcgacgccagaattatttttggataaagatggttaaccattgaaatttatggaagcggtggtcgctcggtaggtacgcctgctatccctaaactga

SEQ ID NO: 2172 - protein, 179 aa, Neisseria gonorrhoeae
  misc_feature (160)..(160): Xaa can be any naturally occurring amino acid
  misc_feature (172)..(172): Xaa can be any naturally occurring amino acid
MLCMNYQSNSGEGVLVAKTYLLTALIMSMVISGCQVIHANQGKVNTNSAVIAGADAHTPEHVTGLTEQKQVIASDFIVASANPLATQAGYDILKQGGSAADAMVAVQTTLSLVEPQSSGLGGGAFVLYWDNTAKTLTTFDGRETAPMRATPELFLDKDGXPLKFMEAVVARXVRLLSLN

SEQ ID NO: 2173 - DNA, 546 bp, Neisseria meningitidis
atgccttgtatgaatcatcaatcaaactcaggcgaaggagtgcttgtggctaaaacatatttattgactgcattgataatgtctatgacaatctctggatgtcaagtcatccatgccaatcaaggtaaggttaatactcattctgctgtcatcacaggtgcagacgctcacacgcctgaacatgcaacgggactgaccgaacaaaagcaggtgattgcaagtgattttatggtagcgtcagccaatccattagcaacacaagctggctatgatatcttaaagcaaggcggtagcgctgcagatgcgatggtggcggtgcagacgacactaagcttggtagagccacagtcgtcaggcttgggcggtggtgcatttgtgttgtattgggataataccgccaaaacattgaccacatttgatgggcgtgagacggcaccgatgcgtgcgacgccggaattatttttggataaagatggtcaaccattgaaatttatggaagcggtggtcgtggtcgctcggtgggtacgcctgctatccctaaactga

SEQ ID NO: 2174 - protein, 181 aa, Neisseria meningitidis
MPCMNHQSNSGEGVLVAKTYLLTALIMSMTISGCQVIHANQGKVNTHSAVITGADAHTPEHATGLTEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVVVARWVRLLSLN

SEQ ID NO: 2175 - DNA, 546 bp, Neisseria meningitidis; identical to SEQ ID NO: 2173

SEQ ID NO: 2176 - protein, 181 aa, Neisseria meningitidis; identical to SEQ ID NO: 2174

SEQ ID NO: 2177 - DNA, 813 bp, Neisseria gonorrhoeae
atgcggtttgtcttctgtttgggcggagagatagtttctgatccgtgtgatttccatttggtattcgtccgcgtcgaatctgccgctgaccagacagaaacgcagatacatcaaatacgtattcacggcatcggtttcgcaataattgcggatttccttcagcgtgcccgcgtggaacgcttcccacactttgctgccgtccatacccagcttgcccggaaagccgcacagtttcgccatatcgtccagcggcacattcgccctcggctggtaaagcgcgagcaaatccatcaaatcgcagtggcgttggtgataacggctgatgtagttgttccacttgaaatcgcggctgtcgccgaaatcgccgtcgcccgtatcccaatagcgcgcggcgttgatgccgtatatcagggagcggtaatgcagtacgggcaggtcgaaaccgccgccgttccagctgaccagttgcggcgtatgtttttcaaccaattcgaaaaacttggcaatcacgacttcttcgccatcgtccatctcgccgatggtgccgacatgaaccttgtcctgcccccagcgcatacagcaggaaaccgccacaacctgatggaggtggtgctgcataaaatcgccgccggtctgtgcgcggcgtttctgctgcgcgaacagcaccacttcgtcatccggcagggaagacggcaagtcatacaacgtacggataccctgcacatcgggtacggtttcaatatcgaaagccaaaatcgtattcatggcagtaccttgcattcaaaaacagacttgcgcctattgtgtcattaa

SEQ ID NO: 2178 - protein, 270 aa, Neisseria gonorrhoeae
MRFVFCLGGEIVSDPCDFHLVFVRVESAADQTETQIHQIRIHGIGFAIIADFLQRARVERFPHFAAVHTQLARKAAQFRHIVQRHIRPRLVKREQIHQIAVALVITADVVVPLEIAAVAEIAVARIPIARGVDAVYQGAVMQYGQVETAAVPADQLRRMFFNQFEKLGNHDFFAIVHLADGADMNLVLPPAHTAGNRHNLMEVVLHKIAAGLCAAFLLREQHHFVIRQGRRQVIQRTDTLHIGYGFNIESQNRIHGSTLHSKTDLRLLCH

SEQ ID NO: 2179 - DNA, 672 bp, Neisseria meningitidis
atgcggcttttccccggcttgtgcggacaggtaattccgcatccgtttgatttccatttcgtattcgtccgcatccagcctgccgctgaccagacagaaacgcaggtacatcagataagtgtttgccgcgtcggtttcgcaataattgcggatttccttcagcctgcccgtatggaatgcctcccaaaccttgctgccgtccatacccagcttgcccggaaaaccgcacagtttcgccatatcgtccagcggcacgtttgccctcggctggtaaagcgcgagcaaatccatcaaatcgcagtggcgttggtgataacggctgatgtagttgttccacttgaaatcgcggctgtcgccgaaatcgccgtcgcccatatcccaatagcgcgcggcgttgatgccgtatatcagggagcggtaatgcagtacgggcagatcgaaaccgccgccgttccaactgaccagttgcggcgtatgtttttcaatcaattcgaaaaatttagcaatgaccacttcctcgccgtcatccatctcgccgatggtgccgacatgtactttatcctgcccccaacgcatgcagcacgaaatcgccacaacctgatgaagatgatgctgcataaaatcgccgcccgtctgagcacggcgtttgtgctgggcaatcagcaccacttg

SEQ ID NO: 2180 - protein, 224 aa, Neisseria meningitidis
MRLFPGLCGQVIPHPFDFHFVFVRIQPAADQTETQVHQISVCRVGFAIIADFLQPARMECLPNLAAVHTQLARKTAQFRHIVQRHVCPRLVKREQIHQIAVALVITADVVVPLEIAAVAEIAVAHIPIARGVDAVYQGAVMQYGQIETAAVPTDQLRRMFFNQFEKFSNDHFLAVIHLADGADMYFILPPTHAARNRHNLMKMMLHKIAARLSTAFVLGNQHHL

SEQ ID NO: 2181 - DNA, 812 bp, Neisseria meningitidis
atgcggtttgtcttctgtttgggcggagagatagtttctgatccgcttgatttccatttcgtattcgtctgcgtcgaatctgccgctgaccagacagaaacgcagatacatcagataggtatttaccgcatcggtttcgcaataattgcggatttccttcagcctgcccgcgtggaacgcctcccacaccttgctgccgtccatacccagcttgcccggaaaaccgcacagtttcgccatatcgtccaacggcacattcgccctcggctggtaaagcgcgagcaaatccatcaaatcgcaatgacgttggtggtagcggctgatgtagttgttccacttgaaatcgcggctgtcgccgaaatcgccgtcgcccatatcccaatagcgcgcggcgttgatgccgtgtagcagcgaacggtaatgcagaaccggcaggtcgaaaccgccgccgttccaactgaccagttgcggcgtatgtttttcaatcaactcgaaaaatttggcgataaccacttcctcgccgtcatccatctcgccgattgtaccgacatggactttatcctgcccccaacgcatgcagcacgaaatcgccacaatctgatgaagatgatgctgcataaaatccccacccgtctgagcacggcgtttttgctgggcaaacagcaccacttcatcgtcgggcagcgaggacggcaagtcatacagcgtacggatacactgcacatcgggtacggtttcaatatcgaaagccaaaatcgtggtcatgacagcaccttgtatttaaaacagacttgcgcctattgtgtcattaa

SEQ ID NO: 2182 - protein, 269 aa, Neisseria meningitidis
  misc_feature (262)..(262): Xaa can be any naturally occurring amino acid
MRFVFCLGGEIVSDPLDFHFVFVCVESAADQTETQIHQIGIYRIGFAIIADFLQPARVERLPHLAAVHTQLARKTAQFRHIVQRHIRPRLVKREQIHQIAMTLVVAADVVVPLEIAAVAEIAVAHIPIARGVDAVQRTVMQNRQVETAAVPTDQLRRMFFNQLEKFGDNHFLAVIHLADCTDMDFILPPTHAARNRHNLMKMMLHKIPTRLSTAFLLGKQHHFIVGQRGRQVIQRTDTLHIGYGFNIESQNRGHDSTLYLKXDLRLLCH

SEQ ID NO: 2183 - DNA, 321 bp, Neisseria gonorrhoeae
atgcgccgcatcgttaaaaaacaccagcccgtaaacgcgccacatatcgttttggaaattcggataatgaaactgcatcgcgcgtttgtcttccttgggcggaaacgtccccatcatcatgaccgcagccttcggcggcaacacgggatcgaagggatgggtttcgatttcaagcagattttcagacacgttcaatcctccaacaggcaaagcggcagacagccggtttgcaccaaaccgccaaacacggcaagccttcaaacagcattatcacgccctgccgttttcggttacaatgccgacatcaaacggatactgtaa

SEQ ID NO: 2184 - protein, 106 aa, Neisseria gonorrhoeae
MRRIVKKHQPVNAPHIVLEIRIMKLHRAFVFLGRKRPHHHDRSLRRQHGIEGMGFDFKQIFRHVQSSNRQSGRQPVCTKPPNTASLQTALSRPAVFGYNADIKRIL

SEQ ID NO: 2185 - DNA, 321 bp, Neisseria meningitidis
atgcgccgcatcattaaaaaacaccagcccataaacgcgccacatatcgttttggaaattcggataatgaaactgcatcgcgcgtttgtcttccttgggcggaaacgtccccatcatcatgacagcagccttcggcggcaacacgggatcgaagggatgggtttcgatttcaagcagattttcagacacgttcaatcctccaacaggcaaaacggcagacagccggtttgcaccaaaccgccaaacacggcaagccttcaaacagcattatcacgccctgccgttttcggttacaatgccgacatcaaacggatactgtaa

SEQ ID NO: 2186 - protein, 106 aa, Neisseria meningitidis
MRRIIKKHQPINAPHIVLEIRIMKLHRAFVFLGRKRPHHHDSSLRRQHGIEGMGFDFKQIFRHVQSSNRQNGRQPVCTKPPNTASLQTALSRPAVFGYNADIKRIL

SEQ ID NO: 2187 - DNA, 321 bp, Neisseria meningitidis
atgcgccgcatcattaaaaaacaccagcccgtaaacgcgccacatatcgttttggaaattcggataatgaaactgcatcgcgcgtttgtcttccttgggcggaaacgtccccatcatcatgaccgcagccttcggcggcaacacggaatcgaagggatgggtttcgatttcaagcagattttcagacacgttcaatcctccaacaggcaaaacggcagacagccggtttgcaccaaaccgccaaacacggcaagccttcaaacagcattatcacgccctgccgttttcggttacaatgccgacatcaaacggatactgtaa

SEQ ID NO: 2188 - protein, 106 aa, Neisseria meningitidis
MRRIIKKHQPVNAPHIVLEIRIMKLHRAFVFLGRKRPHHHDRSLRRQHGIEGMGFDFKQIFRHVQSSNRQNGRQPVCTKPPNTASLQTALSRPAVFGYNADIKRIL

SEQ ID NO: 2189 - DNA, 456 bp, Neisseria gonorrhoeae
atgacttgttgcaggaactgcttggcgcgttcgtgtttcgggttggtgaaaaacgcttccggcgtttcgtcttcaaggatttgccctttatcgacgaaaatcacgcggtcggcaacttcgcgggcaaaccccatttcgtgggttacgcacatcatcgtcatgccgctttccgccaagtctttcatcactttcaacacttcgccgaccatttcggggtcgagtgcggaagtcggctcgtcaaacagcatcacgcgcggctccatcgccagcccgcgcgcaatcgccacgcgttgctgctggccgccggaaagttgggaagggaaggcgtcttttttgtgtgccagtccgacgcgttccaaaagctccattgcctttttctccgcctgttccgcattttgccccttaaccttcatcggtgcgagggtgatgttgtccaacacggtcaggtgcgggtag

SEQ ID NO: 2190 - protein, 151 aa, Neisseria gonorrhoeae
MTCCRNCLARSCFGLVKNASGVSSSRICPLSTKITRSATSRANPISWVTHIIVMPLSAKSFITFNTSPTISGSSAEVGSSNSITRGSIASPRAIATRCCWPPESWEGKASFLCASPTRSKSSIAFFSACSAFCPLTFIGARVMLSNTVRCG

SEQ ID NO: 2191 - DNA, 456 bp, Neisseria meningitidis
atgacctgttgcaggaactgcttggcgcgttcgtgtttcgggttggtaaaaaacgcttcgggcgtttcgtcttcgaggatttgccctttatcgacgaaaatcacgcggtcggcaacttcgcgggcaaaccccatttcgtgggttacgcacatcatcgtcatgccgctttctgccaagtctttcatcactttcaacacttcgccgaccatttcggggtcgagtgcggaggtcggttcgtcaaacaacattacgcgcggttccatcgccaaaccgcgtgcaatcgccacgcgttgctgctggccgccggaaagttgggaagggaaggcgtcttttttgtgtgccagtccgacgcgttccaaaagctccattgcctttttctccgcctgttccgcattttgccccttaaccttcatcggtgcgagggtaatgttttccaacacggtcaggtgcgggtag

SEQ ID NO: 2192 - protein, 151 aa, Neisseria meningitidis
MTCCRNCLARSCFGLVKNASGVSSSRICPLSTKITRSATSRANPISWVTHIIVMPLSAKSFITFNTSPTISGSSAEVGSSNNITRGSIAKPRAIATRCCWPPESWEGKASFLCASPTRSKSSIAFFSACSAFCPLTFIGARVMFSNTVRCG

SEQ ID NO: 2193 - DNA, 456 bp, Neisseria meningitidis
atgacctgttgcaggaactgcttggcgcgttcgtgtttcgggttggtaaaaaacgcttccggcgtttcgtcttcgaggatttgccctttatcgacgaaaatcacgcggtcggcaacttcgcgggcaaaccccatttcgtgggttacgcacatcatggtcataccgctttccgccaagtctttcatcactttcaacacttcgccgaccatttcggggtcgagtgcggaggtcggttcgtcaaacaacattacgcgcggttccatcgccaaaccgcgtgcaatcgccacgcgttgctgctggccgccggaaagttgggaagggaaggcgtcttttttgtgtgccagtccgacgcgttccaaaagttccatcgcttttttctctgcctgttccgcattttgacctttaaccttcatcggtgcgagggtaatgttttccaacacggtcaggtgcgggtag

SEQ ID NO: 2194 - protein, 150 aa, Neisseria meningitidis
MTCCRNCLARSCFGLVKNASGVSSSRICPLSTKITRSATSRANPISWVTHIMVIPLSAKSFITFNTSPTISGSSAEVGSSNNITRGSIAKPRAIATRCCWPPESWEGKASFLCASPTRSKSSIAFFSACSAFPLTFIGARVMFSNTVRCG

SEQ ID NO: 2195 - DNA, 447 bp, Neisseria gonorrhoeae
atgatcagcagggtaacaatcaaaacgcctttcaatgcaccgaatacaccgcccaaaatgcggttggcaaagcccagaccgaccgccgaaactgcgccggtcagcagcgaacggagcattttctggatcagacaggcaatgacgaacagggaaatgaatgacagagccaatgcaaacaggcggggttggaacgaggcaaaggcgaggtcggcgaagggtgcggcaaagagtttggcaaaaaagaaggaaaccacccatgccaccatcgaacctgcttccgcaatcacgccgcgcatcgtggaaatgacgatgcaggcggcgatgacggcggaggcgaggaggtcggcaatggggaggctattcattcgttacctggccggcgatgccgtgcacgcgcagtttgttcaaatcgcgttcggcatcccttgcgtttttatagttgcttga

SEQ ID NO: 2196 - protein, 148 aa, Neisseria gonorrhoeae
MISRVTIKTPFNAPNTPPKMRLAKPRPTAETAPVSSERSIFWIRQAMTNREMNDRANANRRGWNEAKARSAKGAAKSLAKKKETTHATIEPASAITPRIVEMTMQAAMTAEARRSAMGRLFIRYLAGDAVHAQFVQIAFGIPCVFIVA

SEQ ID NO: 2197 - DNA, 447 bp, Neisseria meningitidis
atgaccagcagggtaacaatcaaaacgcctttcaatgcaccgaatacgccgcccaaaatgcggttggcaaagcccaaaccgaccgccgaaactgcgctggtcagcagcgaacggagcattttctggatcagacaggcaatgacgaacagggaaatgaacgacagagccaatgcaaacaggcggggttggaacgaggcaaaggcgaggtcggcgaaggaggcggcaaagagtttggcgaaaaagaaggaaaccacccatgccgccattgagcctgcctccgcaatcacgccgcgcatcgcggatagcacgatgcaggcggcgatgacggcggagacgaggaggtcggcaatggggaggctattcattcgttacctgaccggcgataccgtgtacgcgcaatttgttcaaatcgcgttcggcatcccttgcgtttttatagttgcttga

SEQ ID NO: 2198 - protein, 148 aa, Neisseria meningitidis
MTSRVTIKTPFNAPNTPPKMRLAKPKPTAETALVSSERSIFWIRQAMTNREMNDRANANRRGWNEAKARSAKEAAKSLAKKKETTHAAIEPASAITPRIADSTMQAAMTAETRRSAMGRLFIRYLTGDTVYAQFVQIAFGIPCVFIVA

SEQ ID NO: 2199 - DNA, 447 bp, Neisseria meningitidis
atgaccagcagggtaataatcaaaatgcctttcaatgcaccgaatacgccgcccaaaatgcggttggcaaagcccaaaccgaccgccgaaactgccccggtcagcagcgagcggagtattttctggatcagacaggcaatgacgaatagggaaatgaacgacagagccaatgcaaacaggcggggttggaacgatgcaaaggcgatgtcggcgaagggtgcggcaaagagtttggcgaaaaaaaaggcaaccacccatgccgccattgagccagcctccgcaatcacgccgcgcatcgcggatagcacgatgcaggcggcgatgatggcggagacgaggaggtcggcaacggggaggttattcattcgttacctgaccggcgataccgtgtacgcgcaatttgttcaaatcgcgttcggcatcccttgcgtttttatagttgcttga

SEQ ID NO: 2200 - protein, 148 aa, Neisseria meningitidis
MTSRVIIKMPFNAPNTPPKMRLAKPKPTAETAPVSSERSIFWIRQAMTNREMNDRANANRRGWNDAKAMSAKGAAKSLAKKKATTHAAIEPASAITPRIADSTMQAAMMAETRRSATGRLFIRYLTGDTVYAQFVQIAFGIPCVFIVA

SEQ ID NO: 2201 - DNA, 627 bp, Neisseria gonorrhoeae
atgaggaaaatccgcaccaaaatctgcggcatcaccacaccggaagacgcactgtatgccgcccacgccggcgcagacgcattgggactggttttttacccccaaagcccccgcgctatcgacatcattaaagcacaaaaaatcgccgccgcactgccgccgtttgtcagcgttgtcgcccttttcgtcaacgaaagcgcgcaaaacatccgccgcatccttgccgaagtgccgatacacatcatccaattccacggcgacgaagacgatgcattctgccggcagttcgaccgcccctatattaaagccattcgtgttcagacggcatcagacatccgaaacgccgccacgcgcttccccaacgctcaggcactgctgttcgatgcctatcacccttcggaatacggcggcaccggacaccgcttcgactggacgctgttggcggaatattcgggcaagccgtgggtgcttgccggcgggctgacccctgaaaacgtcggcgaagccgtccgcatcaccggagcggaagcggtcgacgtatccggcggcgtggaagcgtctaaaggcaaaaaagaccccgccaaagtcgccgcctttatcgcaaccgccaaccgcctatcccgttaa

SEQ ID NO: 2202 - protein, 208 aa, Neisseria gonorrhoeae
MRKIRTKICGITTPEDALYAAHAGADALGLVFYPQSPRAIDIIKAQKIAAALPPFVSVVALFVNESAQNIRRILAEVPIHIIQFHGDEDDAFCRQFDRPYIKAIRVQTASDIRNAATRFPNAQALLFDAYHPSEYGGTGHRFDWTLLAEYSGKPWVLAGGLTPENVGEAVRITGAEAVDVSGGVEASKGKKDPAKVAAFIATANRLSR

SEQ ID NO: 2203 - DNA, 627 bp, Neisseria meningitidis
atgaggaaaatccgcaccaaaatctgcggcatcaccacaccggaagacgcagctgccgccgcagcggcaggtgcggatgccgtcgggctggtctttttccaaggcagcagccgggccgtcgatattgcccgcgccaaaaaaatcaccgccgcactgccgccgtttgtcagcgttgtcgcccttttcgtcaacgaaagcgcgcaaaacatccgccgcatccttgccgaagtgccgatacacatcatccaattccacggcgacgaagacgacgcattctgccgccagttccaccgcccctatatcaaagccattcgtgttcagacggcatcagacatccgaaacgccgccacgcgcttccccgacgctcaggcactgctgttcgatgcctaccatccttcggaatacggcggcaccggaaaccgcttcgactggacgctgctggcggaatattcgggcaaaccgtgggtgcttgccggcgggctgacccctgaaaacgtcggcgaagccgtccgcatcaccggagcggaatcggtcgatgtatccggcggtgtggaagcgtctaaaggcaaaaaagatgccgccaaagtcgccgcctttatcgcaaccgccaaccgcctatcccgttaa

SEQ ID NO: 2204 - protein, 208 aa, Neisseria meningitidis
MRKIRTKICGITTPEDAAAAAAAGADAVGLVFFQGSSRAVDIARAKKITAALPPFVSVVALFVNESAQNIRRILAEVPIHIIQFHGDEDDAFCRQFHRPYIKAIRVQTASDIRNAATRFPDAQALLFDAYHPSEYGGTGNRFDWTLLAEYSGKPWVLAGGLTPENVGEAVRITGAESVDVSGGVEASKGKKDAAKVAAFIATANRLSR

SEQ ID NO: 2205 - DNA, 627 bp, Neisseria meningitidis
atgaggaaaatccgcaccaaaatctgcggcatcaccacaccggaagacgcactgtatgccgcccacgccggcgcagacgcattgggactggttttttacccccaaagcccccgcgctgtcgacatcattaaagcacaaaaaatcaccgccgcactgccgccgtttgtcagcgttgtcgcccttttcgtcaacgaaagcgcgcaaaacatccgccgcatccttgccgaagtaccgatacacatcatccaattccacggcgacgaagacgacgcattctgccgccagttccaccgcccctatatcaaggccattcgtgttcagacggcatcagacatccgaaacgccgccgaccgcttccccgacgctcaggcactgctgttcgatgcctaccatccttcggaatacggcggcaccggacaccgcttcgactggacgctgttggcggaatattcgggcaaaccgtgggtgcttgccggcgggctgacccctgaaaacgtcgacgaagccatccgcatcaccggagcggaagcggtcgatgtatccggcggcgtggaagcgtctaaaggcaaaaaagacccagccaaagttgccgcctttatcgcaaccgccaaccgcctatcccgttaa

SEQ ID NO: 2206 - protein, 208 aa, Neisseria meningitidis
MRKIRTKICGITTPEDALYAAHAGADALGLVFYPQSPRAVDIIKAQKITAALPPFVSVVALFVNESAQNIRRILAEVPIHIIQFHGDEDDAFCRQFHRPYIKAIRVQTASDIRNAADRFPDAQALLFDAYHPSEYGGTGHRFDWTLLAEYSGKPWVLAGGLTPENVDEAIRITGAEAVDVSGGVEASKGKKDPAKVAAFIATANRLSR

SEQ ID NO: 2207 - DNA, 924 bp, Neisseria gonorrhoeae
atggatattgaaaccttccttgcaggggaacgcgccgccggcggataccgttgcggcttcgtggcgattgtcggtcgtccgaacgtgggcaaatcaacgctgatgaaccatctcatcggtcagaaaatcagtattaccagcaaaaaggcgcagacgacgcgcaaccgcgtaacggggatttataccgacgataccgcgcagttcgtgtttgtcgatacgccgggctttcaaaccgaccaccgcaacgcgctcaacgacaggctgaatcaaaatgttaccgaggcgctcggcggtgtggatgtggtggttttcgtcgtggaggcgatgcgccttaccgatgccgaccgcgtcgtgttgaaacaactgcccaagcacacgccggtcattttagtgatcaacaaaatcgacaaggacaaggcgaaagaccgttacgcgctggaggcgtttgttgcccaagtgcgcgccgaatttgaatttgcggcggcggaggcggtcagtgcgaaacacggtttgcggattgccaacctgttggagctgctcaagccgtatctgcccgaaagcgtaccgatgtatcccgaagacatggttacggacaaatcggcgcgttttttggcgatggaaatcgtgcgtgaaaaactcttccgctatttgggcgaggagctgccttatgcgatgaacgtcgaagtggagcagtttgaagagggagacggtttgaaccgcatctacatcgccgttttggtcgacaaagaaagccaaaaggcgattttgatcggtaaaggcggggagcgtttgaaaaaaatttccaccgaagcgcggctggatatggaaaaactgtttgataacaaagtatttttgaaggtctgggtcaaagtcaaatccggttgggcagacgacattcgcttcctgcgcgagctgggtttgtag

SEQ ID NO: 2208 - protein, 307 aa, Neisseria gonorrhoeae
MDIETFLAGERAAGGYRCGFVAIVGRPNVGKSTLMNHLIGQKISITSKKAQTTRNRVTGIYTDDTAQFVFVDTPGFQTDHRNALNDRLNQNVTEALGGVDVVVFVVEAMRLTDADRVVLKQLPKHTPVILVINKIDKDKAKDRYALEAFVAQVRAEFEFAAAEAVSAKHGLRIANLLELLKPYLPESVPMYPEDMVTDKSARFLAMEIVREKLFRYLGEELPYAMNVEVEQFEEGDGLNRIYIAVLVDKESQKAILIGKGGERLKKISTEARLDMEKLFDNKVFLKVWVKVKSGWADDIRFLRELGL

SEQ ID NO: 2209 - DNA, 924 bp, Neisseria meningitidis
atggatattgaaaccttccttgcaggggaacgcgccgccggcggataccgttgcggcttcgtagcgattgtcggccgtccgaacgtgggcaaatcaacgctgatgaaccatctcatcggtcagaaaatcagtattaccagcaaaaaggcgcagacgacgcgcaaccgcgtaacggggatttataccgacgataccgcgcagttcgtgtttgtcgatacgcccggctttcaaaccgaccaccgcaacgcgctcaacgacaggctgaatcaaaatgttaccgaggcgctcggcggcgtggatgtggtggttttcgtcgtggaggcgatgcgctttaccgatgccgaccgcgtcgtgttgaaacaactgcccaagcacacgccggtcattttagtggtcaacaaaatcgacaaggacaaggcgaaagaccgttacgcgctggaggcgtttgttgcccaagtgcgcgccgaatttgaatttgcggcggcggaggcggtcagcgcgaaacacggattgcggattgccaacctgttggagctgattaagccgtatctgcccgaaagcgtgccgatgtatcccgaagatatggttacggacaaatcggcgcgttttttggcgatggaaatcgtgcgtgaaaaattgttccgctatttgggcgaggaattgccttatgcgatgaacgtcgaagtggagcagtttgaagaggaagacggtttgaaccgcatctatatcgccgttttggtcgataaggaaagccaaaaggcaattttaatcggtaaaggcggagaacgtttgaagaaaatttccaccgaagcgcggttggatatggaaaaactgtttgataccaaagtatttttgaaggtctgggtcaaagtcaaatccggttgggcggacgacatccgcttcctgcgcgagctgggtttgtag

SEQ ID NO: 2210 - protein, 307 aa, Neisseria meningitidis
MDIETFLAGERAAGGYRCGFVAIVGRPNVGKSTLMNHLIGQKISITSKKAQTTRNRVTGIYTDDTAQFVFVDTPGFQTDHRNALNDRLNQNVTEALGGVDVVVFVVEAMRFTDADRVVLKQLPKHTPVILVVNKIDKDKAKDRYALEAFVAQVRAEFEFAAAEAVSAKHGLRIANLLELIKPYLPESVPMYPEDMVTDKSARFLAMEIVREKLFRYLGEELPYAMNVEVEQFEEEDGLNRIYIAVLVDKESQKAILIGKGGERLKKISTEARLDMEKLFDTKVFLKVWVKVKSGWADDIRFLRELGL

SEQ ID NO: 2211 - DNA, 924 bp, Neisseria meningitidis
atggatattgaaaccttccttgcaggggaacgcgccgccgacggataccgttgcggcttcgtagcgattgtcggccgtccgaacgtgggcaaatcaacgctgatgaatcatctcatcggtcagaaaatcagtattaccagcaaaaaggcgcagacgacgcgcaaccgcgtaacggggatttataccgacgataccgcgcagtttgtgtttgtcgatacgcccggttttcaaaccgaccaccgcaacgcgctcaacgaccgtttgaatcaaaacgttaccgaggcactcggcggcgtggatgtggtggttttcgtcgtggaagcgatgcgttttaccgatgccgaccgcgtcgtgttgaaacaactgcccaagcacacgccggtcattttagtggtcaacaaaatcgataaggacaaggcgaaagaccgttacgcgctggaggcgtttgttgcccaggtgcgcgccgaatttgaatttgcggcggcggaggcggtcagcgcgaaacacggattgcggattgccaacctgttggagctgattaagccgtatctgcccgaaagcgtgccgatgtatcccgaagatatggttacggacaaatcggcgcgttttttagcgatggaaatcgtgcgtgaaaaattgttccgctatttgggcgaggaattgccttatgcgatgaacgtcgaagtggagcagtttgaagaggaagacggtttgaaccgcatctatatcgccgttttggtcgataaggaaagccaaaaggcgattttaatcggcaaaggcggggagcgtttgaagaaaatttccaccgaagcgcggttggatatggaaaaactgtttgataccaaagtatttttgaaggtctgggtcaaagtcaaatccggttgggcggacgacatccgcttcctgcgcgagctgggtttgtag

SEQ ID NO: 2212 - protein, 307 aa, Neisseria meningitidis
MDIETFLAGERAADGYRCGFVAIVGRPNVGKSTLMNHLIGQKISITSKKAQTTRNRVTGIYTDDTAQFVFVDTPGFQTDHRNALNDRLNQNVTEALGGVDVVVFVVEAMRFTDADRVVLKQLPKHTPVILVVNKIDKDKAKDRYALEAFVAQVRAEFEFAAAEAVSAKHGLRIANLLELIKPYLPESVPMYPEDMVTDKSARFLAMEIVREKLFRYLGEELPYAMNVEVEQFEEEDGLNRIYIAVLVDKESQKAILIGKGGERLKKISTEARLDMEKLFDTKVFLKVWVKVKSGWADDIRFLRELGL

SEQ ID NO: 2213 - DNA, 426 bp, Neisseria gonorrhoeae
atgaaaacagcccgccgccgttcccgcgagcttgccgtacaagccgtttaccaatcccttatcaaccgcaccgccgcgcccgaaattgctaaaaacatccgcgaaatgtccgactttgccaaagcggacgaagaattgttcaacaaactcttcttcggcacacaaaccaatgcagcggactacatccaaaaaatccgcccgctgctcgacagggacgaaaaagacctcaaccccatcgaacgcgccgttttgctgaccgcctgccacgagctttccgctatgcccgaaacgccctaccccgtcattatcaacgaagccatcgaagttaccaaaaccttcggcggcacggacgggcacaaattcgtcaacggcatcctcgacaaactcgccgcccaaatccgcccagacgagcccaaacgccgttga

SEQ ID NO: 2214 - protein, 141 aa, Neisseria gonorrhoeae
MKTARRRSRELAVQAVYQSLINRTAAPEIAKNIREMSDFAKADEELFNKLFFGTQTNAADYIQKIRPLLDRDEKDLNPIERAVLLTACHELSAMPETPYPVIINEAIEVTKTFGGTDGHKFVNGILDKLAAQIRPDEPKRR

SEQ ID NO: 2215 - DNA, 426 bp, Neisseria meningitidis
atgaaaacagcccgccgccgttcccgcgagcttgccgtacaagccgtttaccaatcccttatcaaccgcaccgccgcgcccgaaattgctaaaaacatccgcgaaatgtccgactttgccaaggcagacgaagaattgttcaacaaacttttcttcggcacgcaaaccaatgcggcagagtatatccgacaaatccgcccgctacttgacagggacgaaaaagacctcaaccccatcgaacgcgccgttttgctgaccgcctgccacgagctgtccgccatgcccgaaacgccctaccccgtcattatcaacgaagccatcgaagttaccaaaaccttcggcggcacggacgggcacaaattcgtcaacggcatcctcgacaaactcgccgcccaaatccgccccgacgagcccaaacgccgttga

SEQ ID NO: 2216 - protein, 141 aa, Neisseria meningitidis
MKTARRRSRELAVQAVYQSLINRTAAPEIAKNIREMSDFAKADEELFNKLFFGTQTNAAEYIRQIRPLLDRDEKDLNPIERAVLLTACHELSAMPETPYPVIINEAIEVTKTFGGTDGHKFVNGILDKLAAQIRPDEPKRR

SEQ ID NO: 2217 - DNA, 426 bp, Neisseria meningitidis
atgaaaacagcccgccgccgttcccgcgagcttgccgtacaagccgtttaccaatcccttatcaaccgcaccgccgcgcccgagattgctaaaaacatccgcgaaatgcccgactttgccaaggcagacgaagaattgttcaacaaacttttcttcggcacgcaaaccaatgcggcagagtacatccgacaaatccgccccctgctcgaccgcgacgaaaaagacctcaaccccatcgaacgcgccgtcctgctgaccgcctgccacgagctgtccgccatgcccgaaacgccctaccccgtcatcatcaacgaagccatcgaagtaaccaaaaccttcggcggcacggacgggcacaaattcgtcaacggcatcctcgacaaactcgccgcccaaatccgtcccgacgagcccaaacgccgttga

SEQ ID NO: 2218 - protein, 141 aa, Neisseria meningitidis
MKTARRRSRELAVQAVYQSLINRTAAPEIAKNIREMPDFAKADEELFNKLFFGTQTNAAEYIRQIRPLLDRDEKDLNPIERAVLLTACHELSAMPETPYPVIINEAIEVTKTFGGTDGHKFVNGILDKLAAQIRPDEPKRR

SEQ ID NO: 2219 - DNA, 477 bp, Neisseria gonorrhoeae
atgaacaccatcgcccccaacctcgacggcaaacacctccgcatcggcatcgtacaggcacgcttcaccaacgaaatcggcagccaaatgctcaaagtctgctgccgcaccctccaagaattgggcgtagcagacgaaaacatcaccgtcgccaccgtacccggcgcgcttgaaatccccatcgcgctgatgaactttgcctcttccgaaaaatttgacgcactgattgccatcggcgtcgtcatccgtggcgaaacctaccatttcgagctggttgccaacgaatccggcgcagggatcggccgcgtcgcactcgactacaacatcccgattgccaacgccgtcctgaccaccgaaaacgacgcgcaggcaattgaacggattggagaaaaagcctcggatgccgccaaagtcgccgtagaatgcgccaacctcgtcaaccttctgctcgaagaacagtttgaagacgaagaataa

SEQ ID NO: 2220 - protein, 158 aa, Neisseria gonorrhoeae
MNTIAPNLDGKHLRIGIVQARFTNEIGSQMLKVCCRTLQELGVADENITVATVPGALEIPIALMNFASSEKFDALIAIGVVIRGETYHFELVANESGAGIGRVALDYNIPIANAVLTTENDAQAIERIGEKASDAAKVAVECANLVNLLLEEQFEDEE

SEQ ID NO: 2221 - DNA, 477 bp, Neisseria meningitidis
atgaacaccatcgcccccaacctcgacggcaaacacctccgcatcggcatcgtacaggcacgcttcaccaacgaaatcggcagcgaaatgctcaaagtctgctgccgcaccctccaagaattgggcgtggcagacgaaaacattaccgtcgccaccgtacccggcgcgcttgaaatccccatcgcgctgatgaactttgcctcttccgaaaagtttgacgcactgattgccatcggcgtcgtcatccgtggcgaaacctaccatttcgagctggtttccaacgaatccggagcaggcgtcagccgcgtcgcactcgactacaatatcccgattgccaatgccgtcctaaccaccgaaaacgacgcgcaggcaatcgaacggattgaagaaaaagcctcggatgccgccaaagtcgccgtcgaatgcgccaacctcgtcaacctgctgctcgaagaacagtttgaagacgaagaataa

SEQ ID NO: 2222 - protein, 158 aa, Neisseria meningitidis
MNTIAPNLDGKHLRIGIVQARFTNEIGSEMLKVCCRTLQELGVADENITVATVPGALEIPIALMNFASSEKFDALIAIGVVIRGETYHFELVSNESGAGVSRVALDYNIPIANAVLTTENDAQAIERIEEKASDAAKVAVECANLVNLLLEEQFEDEE

SEQ ID NO: 2223 - DNA, 477 bp, Neisseria meningitidis
atgaacaccatcgcccccaacctcgacggcaaacacctccgcatcggcatcgtacaggcacgcttcaccaacgaaatcggcagcgaaatgctcaaagtctgctgccgcaccctccaagaattgggcgtggcagacgaaaacattaccgtcgccaccgtacccggcgcgcttgaaatccccatcgcgctgatgaactttgcctcttctgaaaaatttgacgcactgattgccatcggcgtcgttatccgtggcgaaacctaccatttcgagctggtttccaacgaatccggagcaggggtcagccgcgtcgcactcgactacaacatcccgattgccaatgccgtcctgaccacggaaaacgacgcacaggcaatcgaacggattgaagaaaaagcctcggatgccgccaaagtcgccgtagaatgcgccaacctcgtcaacctcctgctcgaagaacagtttgaagacgaagaataa

SEQ ID NO: 2224 - protein, 158 aa, Neisseria meningitidis; identical to SEQ ID NO: 2222

SEQ ID NO: 2225 - DNA, 597 bp, Neisseria gonorrhoeae
atgccgcagattttggtgcggattttcctcattcggtattcctttatttgggaaacggtgcgcttgtgccgtttcagacggcattcccgatcagtcgattttgatgtattcgacagaaaggatttcaatttcctcacggccttccggcgtgttcaaaaccacttcgtcgccttcgcgcgctttaatcaggcaacgcgccaacggcgaaatccaagaaattttgttttgcgcggtatcgatttcatcgacgccgacgattttgacggtttgctcgcgcccgtcgccgcgcaacagaccgacggtcgcgccgaaaaatacttggtcggtcgcttcgcgcaattcgggatcgacgacgacggcagcctccaaacgtttggtcaggaaacggatgcggcggtcgatttcgcgcatacggcgtttgccgtaaagatagtcgccgttttcgctgcggtcgccgttgcctgccgcccagttgacgatttggacgatttcggggcgttctttattgaccagttgataaagctcgtctttcaatgcctgccatccggcgggcgtaatgtagtttttggtttcggtactcatattgtgtgcggatga

SEQ ID NO: 2226 - protein, 198 aa, Neisseria gonorrhoeae
MPQILVRIFLIRYSFIWETVRLCRFRRHSRSVDFDVFDRKDFNFLTAFRRVQNHFVAFARFNQATRQRRNPRNFVLRGIDFIDADDFDGLLAPVAAQQTDGRAEKYLVGRFAQFGIDDDGSLQTFGQETDAAVDFAHTAFAVKIVAVFAAVAVACRPVDDLDDFGAFFIDQLIKLVFQCLPSGGRNVVFGFGTHIVCG

SEQ ID NO: 2227 - DNA, 597 bp, Neisseria meningitidis
atgccgcagattttggtgcggattttcctcattcggtattcctttatttgggaaacggcgcgcttttgccgtttcagacggcattcccgatcagtcgattttgatgtattcgacagaaaggatttcaatttcctcacgcccttccggcgtgttcaaaaccacttcgtcgccttcgcgcgctttaatcagacaacgagccagcggcgaaatccaagaaattttgttttgcgcggtatcgatttcatcgatgccgacgattttgacggtttgctcgcgcccgtcgtcgcgcaacagtccgaccgtcgcgccgaaaaacacttggtcggtcgcttcgcgcaattcgggatcgacgacgacggcagcctccaaacgtttggtcaggaaacggatgcggcggtcgatttcgcgcatacggcgtttgccgtaaagatagtcgccgttttcgctgcggtcgccgttgcctgccgcccagttgacgatttggacgatttcggggcgttctttgttgaccagttgataaagctcgtctttcaatgcctgccatccggcgggcgtaatgtagtttttggtttcggtactcatattgtgtgcggatga

SEQ ID NO: 2228 - protein, 198 aa, Neisseria meningitidis
MPQILVRIFLIRYSFIWETARFCRFRRHSRSVDFDVFDRKDFNFLTPFRRVQNHFVAFARFNQTTSQRRNPRNFVLRGIDFIDADDFDGLLAPVVAQQSDRRAEKHLVGRFAQFGIDDDGSLQTFGQETDAAVDFAHTAFAVKIVAVFAAVAVACRPVDDLDDFGAFFVDQLIKLVFQCLPSGGRNVVFGFGTHIVCG

SEQ ID NO: 2229 - DNA, 597 bp, Neisseria meningitidis
atgccgcagattttggtgcggattttcctcattcggtattcctttatttgggaaacggcgcgtttgtgccgtttcagacggcattcccgatcagtcgattttgatgtattcgacagaaaggatttcaatttcctcacgcccttccggcgtgtttaaaaccacttcgtcgccttcacgcgctttaatcagacaacgagccagcggcgaaatccaagaaattttgttttgcgcggtatcgatttcatcgatgccgacgattttgacggtttgctcgcgcccgtcgccgcgcaacagaccgacggtcgcgccgaaaaacacttggtcggtcgcttcgcgcaattcgggatcaacgacgacggcggcttccaaacgcttggtcaggaaacggatgcggcggtcgatttcgcgcatacggcgtttgccgtaaaggtagtcgccgttttcgctgcggtcgccgttgcctgccgcccagttgacgatttggacgatttcggggcgttctttattaaccagttgataaagctcgtctttcaatgcctgccatccggcgggcgtaatgtagtttttggtttcggtactcatattgtgtgcggatga

SEQ ID NO: 2230 - protein, 197 aa, Neisseria meningitidis
MPQILVRIFLIRYSFIWETARLCRFRRHSRSVDFDVFDRKDFNFLTPFRRVNHFVAFTRFNQTTSQRRNPRNFVLRGIDFIDADDFDGLLAPVAAQQTDGRAEKHLVGRFAQFGINDDGGFQTLGQETDAAVDFAHTAFAVKVVAVFAAVAVACRPVDDLDDFGAFFINQLIKLVFQCLPSGGRNVVFGFGTHIVCG

SEQ ID NO: 2231 - DNA, 498 bp, Neisseria gonorrhoeae
atgaatagcctccccattgccgacctcctcgcctccgccgtcatcgccgcctgcatcgtcatttccacgatgcgcggcgtgattgcggaagcaggttcgatggtggcatgggtggtttccttcttttttgccaaactctttgccgcacccttcgccgacctcgcctttgcctcgttccaaccccgcctgtttgcattggctctgtcattcatttccctgttcgtcattgcctgtctgatccagaaaatgctccgttcgctgctgaccggcgcagtttcggcggtcggtctgggctttgccaaccgcattttgggcggtgtattcggtgcattgaaaggcgttttgattgttaccctgctgatcatgcttgcttcaaaaaccgacctgcccgataccgaagaatggcaacagtcctataccgtaccgtttttcgtatcgctttccgaagcggtgttaaaccatacggacaacgcacccgaatccctcgacgacgactaa

SEQ ID NO: 2232 - protein, 165 aa, Neisseria gonorrhoeae
MNSLPIADLLASAVIAACIVISTMRGVIAEAGSMVAWVVSFFFAKLFAAPFADLAFASFQPRLFALALSFISLFVIACLIQKMLRSLLTGAVSAVGLGFANRILGGVFGALKGVLIVTLLIMLASKTDLPDTEEWQQSYTVPFFVSLSEAVLNHTDNAPESLDDD

SEQ ID NO: 2233 - DNA, 498 bp, Neisseria meningitidis
atgaatagcctccccattgccgacctcctcgtctccgccgtcatcgccgcctgcatcgtgctatccgcgatgcgcggcgtgattgcggaggcaggctcaatggcggcatgggtggtttccttctttttcgccaaactctttgccgcctccttcgccgacctcgcctttgcctcgttccaaccccgcctgtttgcattggctctgtcgttcatttccctgttcgtcattgcctgtctgatccagaaaatgctccgttcgctgctgaccagcgcagtttcggcggtcggtttgggctttgccaaccgcattttgggcggcgtattcggtgcattgaaaggcgttttgattgttaccctgctggtcatgcttgcttcaaaaaccgacctgcccgataccgaagaatggcggcaatcttacacactgccgtttttcgtatcgctttccgaagccgtgttgaaccatagcggcggcacggcggaaactccggaagacgattga

SEQ ID NO: 2234 - protein, 165 aa, Neisseria meningitidis
MNSLPIADLLVSAVIAACIVLSAMRGVIAEAGSMAAWVVSFFFAKLFAASFADLAFASFQPRLFALALSFISLFVIACLIQKMLRSLLTSAVSAVGLGFANRILGGVFGALKGVLIVTLLVMLASKTDLPDTEEWRQSYTLPFFVSLSEAVLNHSGGTAETPEDD

SEQ ID NO: 2235 - DNA, 498 bp, Neisseria meningitidis
atgaataacctccccgttgccgacctcctcgtctccgccatcatcgccgcctgcatcgtgctatccgcgatgcgcggcgtgattgcggaggctggctcaatggcggcatgggtggttgccttttttttcgccaaactctttgccgcacccttcgccgacatcgcctttgcatcgttccaaccccgcctgtttgcattggctctgtcgttcatttccctattcgtcattgcctgtctgatccagaaaatactccgctcgctgctgaccggggcagtttcggcggtcggtttgggctttgccaaccgcattttgggcggcgtattcggtgcattgaaaggcattttgattattaccctgctggtcatgctcgcttcaaaaaccgacctgcccgataccgaagaatggcggcaatcttacacactgccgtttttcgtatcgctttccgaagccgtgttgaaccatagcggcggcacggcggaaactccggaagacgattga

SEQ ID NO: 2236 - protein, 165 aa, Neisseria meningitidis
MNNLPVADLLVSAIIAACIVLSAMRGVIAEAGSMAAWVVAFFFAKLFAAPFADIAFASFQPRLFALALSFISLFVIACLIQKILRSLLTGAVSAVGLGFANRILGGVFGALKGILIITLLVMLASKTDLPDTEEWRQSYTLPFFVSLSEAVLNHSGGTAETPEDD

SEQ ID NO: 2237 - DNA, 663 bp, Neisseria gonorrhoeae
atgacgaagggcagttcggcgatgtccagcccacgcgcggcgatatcggtggcgacgaggacgcgcaggctgccgtctttgaaggcgttgagtgtttcgagcctgctttgttgggaacggtcgccgtgtatcgcctgtgcggacaggttgcggcgcaccagttcgcgcgttacgcggtcgacgctttgtttggttttgcaaaagacgataacttggttcatatgcagatcgacaatcagccgttcgagcaggttgcgcttttggaaggtatcgacggcgatgatgtgttgttcgacgttggcgttggtggtgttttgggcggcaacctcgacggtttcgggcgcgttcatgaagtcttgcgccagtttgcgtatcggtgcggagaaggtggcggaaaagagcagggtttggcgttggcggggcagcatctgcatgattttgcggatgtcgtcgataaaccccatatccaacatgcggtctgcttcgtccagaacgacgatttcggctttgtttaaactgatgtttttctgtttcacatggtcgagcagccgtccgacggtggcgacgactatttcgcagccggcacgcaggtcggcggtttgtttgtccatgttgacaccgccgaagaggacggtatgccgcagcggcaggtttttaatgtag

SEQ ID NO: 2238 - protein, 220 aa, Neisseria gonorrhoeae
MTKGSSAMSSPRAAISVATRTRRLPSLKALSVSSLLCWERSPCIACADRLRRTSSRVTRSTLCLVLQKTITWFICRSTISRSSRLRFWKVSTAMMCCSTLALVVFWAATSTVSGAFMKSCASLRIGAEKVAEKSRVWRWRGSICMILRMSSINPISNMRSASSRTTISALFKLMFFCFTWSSSRPTVATTISQPARRSAVCLSMLTPPKRTVCRSGRFLM

SEQ ID NO: 2239 - DNA, 663 bp, Neisseria meningitidis
atgacgaagggcagttcggcaatgtccagcccgcgcgcggcgatgtcggtggcgacgaggacgcgcaggttgccgtctttgaaggcgttgagtgtttcgagccggctttgttgggaacggtcgccgtgtatcgcctgtgcggacaggttgcggcgcaccagttcgcgcgttacgcggtcgacgctttgtttggttttgcagaacacgatgacctggttcatatgcaaatcgacaatcagccgttcgagcaggttgcgcttctgaatggtatcgacggcgatgatgtgctgctcgacgttggcgttggtggtgttttgcgcggcgacttcgacggtttcgggcgcgttcatgaagtcttgcgccagtttgcgtatcggggcggagaaggtggcggaaaagagcagggtttggcgttggcggggcagcatctgcatgattttgcggatgtcgtcgataaaacccatatccagcatacggtcggcttcgtccaaaacgacgatttcgactttgttcaaatggatgtttttctgtttcacgtggtcgagcagccgtccgacggtggcgacgacgatttcgcagccggcacgcaggtcggcggtctgtttgtccatattcataccgccgaacaagacggtgtggcgcagcggcaggtttttgatgtag

SEQ ID NO: 2240 - protein, 219 aa, Neisseria meningitidis
MTKGSSAMSSPRAAMSVATRTRRLPSLKALSVSSRLCWERSPCIACADRLRRTSSRVTRSTLCLVLQNTMTWFICKSTISRSSRLRFMVSTAMMCCSTLALVVFCAATSTVSGAFMKSCASLRIGAEKVAEKSRVWRWRGSICMILRMSSIKPISSIRSASSKTTISTLFKWMFFCFTWSSSRPTVATTISQPARRSAVCLSIFIPPNKTVWRSGRFLM

SEQ ID NO: 2241 - DNA, 663 bp, Neisseria meningitidis
atgacgaagggcagttcggcaatatccagcccccgcgcggcgatatcggtggcgacgaggacgcgcaggttgccgtctttgaaggcgttgagtgtttcgagccggctttgttgggaacggtcgccgtgtatcgcctgtgcggacaggttgcggcgcaccagttcgcgcgttacgcggtcgacgctttgtttggttttgcagaacacgatgacctggttcatatgcaaatcgacaatcagccgttcgagcaggttgcgcttctgaatggtatcgacggcgatgatgtgctgctcgacgttggcgttggtggtgtcttgcgcggcgacttcgacggtttcgggcgcgttcatgaagtcttgcgccagtttgcgtatcggggcggagaaggtggcggaaaagagcagggtttggcgttggcggggcagcatctgcatgattttgcggatgtcgtcgataaaacccatatccagcatacggtcggcttcgtccaaaacgacgatttcgactttgttcaaatggatgtttttctgtttcacgtggtcgagcagccgtccgacggtggcgacgacgatttcgcagccggcacgcaggtcggcggtctgtttgtccatattcataccgccgaacaagacggtgtggcgcagcggcaggtttttgatgtag

SEQ ID NO: 2242 - protein, 219 aa, Neisseria meningitidis
MTKGSSAISSPRAAISVATRTRRLPSLKALSVSSRLCWERSPCIACADRLRRTSSRVTRSTLCLVLQNTMTWFICKSTISRSSRLRFMVSTAMMCCSTLALVVSCAATSTVSGAFMKSCASLRIGAEKVAEKSRVWRWRGSICMILRMSSIKPISSIRSASSKTTISTLFKWMFFCFTWSSSRPTVATTISQPARRSAVCLSIFIPPNKTVWRSGRFLM

SEQ ID NO: 2243 - DNA, 786 bp, Neisseria gonorrhoeae
atgacgacgccgatggcaatcagtgcgtcaaatttttcggaagaggcaaagttcatcagcgcgatggggatttcaagcgcgccgggtacggtggcgacggtgatgttttcgtctgctacgcccaattcttggagggtgcggcagcagactttgagcatttggctgccgatttcgttggtgaagcgtgcctgtacgatgccgatgcggaggtgtttgccgtcgaggttgggggcgatggtgttcattgggtgtcctttggtattcggggtttcggaatgccgtctgaaggtttcagtcttgcggctgccagtcggcaacggtttggaatgtgccgtcttcggcaagctcccacgcgctgccttcgggttgggaaagcagtgcggcggtttcagggttggttttggtgatgtcggcgaggctgacgatgctgaagttgtcggggtcgtcggtgtattcgtcggtttcgtcgccgctgaagaaacgccagccgctgtcgttttcaaaaacgggggcttcgcggtaaaggaagccgacgggccggttttgtttggcgacggtgttggtggcgatgcagcggtcgagtgccgaggaaagtgcttgtgcaaatgcgttcattgcgggaatacgttggggggggggaaacttgcggattttaccacgattcccgcgttgtcggcagacggcggcggtttggtggtacaatgtgcgccgtttgcagccttaaggtgtttctgtatttttggagtatggaaacgcattcgggctgttttttgcggaagacggtaa

SEQ ID NO: 2244 - protein, 261 aa, Neisseria gonorrhoeae
MTTPMAISASNFSEEAKFISAMGISSAPGTVATVMFSSATPNSWRVRQQTLSIWLPISLVKRACTMPMRRCLPSRLGAMVFIGCPLVFGVSECRLKVSVLRLPVGNGLECAVFGKLPRAAFGLGKQCGGFRVGFGDVGEADDAEVVGVVGVFVGFVAAEETPAAVVFKNGGFAVKEADGPVLFGDGVGGDAAVECRGKCLCKCVHCGNTLGGGKLADFTTIPALSADGGGLVVQCAPFAALRCFCIFGVWKRIRAVFCGRR

SEQ ID NO: 2245 - DNA, 782 bp, Neisseria meningitidis
atgacgacgccgatggcaatcagtgcgtcaaacttttcggaagaggcaaagttcatcagcgcgatggggatttcaagcgcgccgggtacggtggcgacggtaatgttttcgtctgccacgcccaattcttggagggtgcggcagcagactttgagcatttcgctgccgatttcgttggtgaagcgtgcctgtacgatgccgatgcggaggtgtttgccgtcgaggttgggggcgatggtgttcattgggtgtcctttggtattcggagtttcggaatgccgtctgaaggtttcagtcttgcggctgccagtcggcgacggtttggaatgtgccgtcttcggcaagctcccatgcgctgccttcgggttgggagagcagtgcggcggtttcagggttggttttggcgatgtcggcgaggctgacgatgctgaagttgtccggatcgtcggtgtattcgtcggtctcgtcgccgctgaagaaacgccagccgctgtcgttttcaaaaacgggggcttcgcggtagaggaagccgacgggccggttttgtttggcgacggtgttggtggcgatacagcggtcgagtgccgaggaaagtgcttgtgcaaatgcgttcattacgggaatacgttgggggaaaacttacggattttaccacgattcgtgcgttgtcggcagacggcggcggtttggtggtacaatgtgcgccgtttgcagccttaaggtgtttctgtatttttggagtatggaaacgcattcgggctgttttttgcggaagacggtaa

SEQ ID NO: 2246 - protein, 260 aa, Neisseria meningitidis
  misc_feature (212)..(212): Xaa can be any naturally occurring amino acid
MTTPMAISASNFSEEAKFISAMGISSAPGTVATVMFSSATPNSWRVRQQTLSISLPISLVKRACTMPMRRCLPSRLGAMVFIGCPLVFGVSECRLKVSVLRLPVGDGLECAVFGKLPCAAFGLGEQCGGFRVGFGDVGEADDAEVVRIVGVFVGLVAAEETPAAVVFKNGGFAVEEADGPVLFGDGVGGDTAVECRGKCLCKCVHYGNTLGXKLTDFTTIRALSADGGGLVVQCAPFAALRCFCIFGVWKRIRAVFCGRR

SEQ ID NO: 2247 - DNA, 782 bp, Neisseria meningitidis
ataacgacgccgatggcaatcagtgcgtcaaatttttcagaagaggcaaagttcatcagcgcgatggggatttcaagcgcgccgggtacggtggcgacggtaatgttttcgtctgccacgcccaattcttggagggtgcggcagcagactttgagcatttcgctgccgatttcgttggtgaagcgtgcctgtacgatgccgatgcggaggtgtttgccgtcgaggttgggggcgatggtgttcattgagtgtcctttggtattcggaggtttcggaatgccgtctgaagggtcagtccttaggttgccagtcggcgacggtttggaatgtgccgtcttctgccaattcccacgcgctgccttcaggttgggagagcagtgcggcggtttcagggttggttttggtgatatcggcgaggctgacgatgctgaagttgtccgggtcgtcggtgtattcgtcggtctcgtcgccgctgaagaaacgccagccgctgtcgttttcaaaaacgggggcttcgcggtagaggaagccgacgggctggttttgtttggcgacggtgttggtggcgatgcagcggtcgagtgccgaggaaagtgcttgtgcaaatgcgttcattgcgggaatacgttgggggaaaacttgcggattttaccacgattcttgcgttgtcggcagacggcggcggtttggtggtacaatgtgcgccgtttgcagccttaaggtgtttctgtatttttggagtatggaaacgcattcgggctgttttttgcggaagacggtaa

SEQ ID NO: 2248 - protein, 260 aa, Neisseria meningitidis
  misc_feature (210)..(210): Xaa can be any naturally occurring amino acid
ITTPMAISASNFSEEAKFISAMGISSAPGTVATVMFSSATPNSWRVRQQTLSISLPISLVKRACTMPMRRCLPSRLGAMVFIECPLVFGGFGMPSEGSVLRLPVGDGLECAVFCQFPRAAFRLGEQCGGFRVGFGDIGEADDAEVVRVVGVFVGLVAAEETPAAVVFKNGGFAVEEADGLVLFGDGVGGDAAVECRGKCLCKCVHCGNTXGGKLADFTTILALSADGGGLVVQCAPFAALRCFCIFGVWKRIRAVFCGRR

SEQ ID NO: 2249 - DNA, 402 bp, Neisseria gonorrhoeae
atgcgcgatttcgccgtatgggtgccttacggggaacggcggaaaaattgggacataaggtattgcctcccgcaccttattcgcctgagcccaacccgattgagaaagtgtgggcgaatattaagcggtatctgcgaaccgttttgtctgattacgcccgatttgacgatgcactactgtcctattttgattttaattgactatatttgtgtgaatgatgaaataaaaatgccgtctgaacccgattggattcagacggcattttgtatggcaggatttattcgctttccaactgaccgacccattctgacaaggcagtcaggcgttgttcggatttcgccacgaacgggttttcggtatcccacgcgtagcctgccaaaatcgaagaaagcatacggctga

SEQ ID NO: 2250 - protein, 133 aa, Neisseria gonorrhoeae
MRDFAVWVPYGERRKNWDIRYCLPHLIRLSPTRLRKCGRILSGICEPFCLITPDLTMHYCPILILIDYICVNDEIKMPSEPDWIQTAFCMAGFIRFPTDRPILTRQSGVVRISPRTGFRYPTRSLPKSKKAYG

SEQ ID NO: 2251 - DNA, 390 bp, Neisseria meningitidis
atgcgtgatttcaccgtatgggtgtcttacgggaaatggcggaaaaattgggacataaggtattgcctcttgcaccttattcacctgagctcaacccgattgagaaagtgtgggcgaatattaagcggtatctgcgaaccgttttgtctgattacgcccgatttgacgatgcactactgtcctattttgattttaattgactatgaaatggcaatgccgtctgaacccgattggattcagacggcattttgtatggcgtacggatttattcggtttccaactgaccgacccattcggacaaggcagtcaggcgttgttcggatttcgccacgaacgggttttcggtatcccacgcgtagcctgccaaaatcgaagaaagcatacggctga

SEQ ID NO: 2252 - protein, 129 aa, Neisseria meningitidis
MRDFTVWVSYGKWRKNWDIRYCLLHLIHLSSTRLRKCGRILSGICEPFCLITPDLTMHYCPILILIDYEMAMPSEPDWIQTAFCMAYGFIRFPTDRPIRTRQSGVVRISPRTGFRYPTRSLPKSKKAYG

SEQ ID NO: 2253 - DNA, 330 bp, Neisseria meningitidis
atgcgcgattttaccgtatgggtgtcttacgggaaatggcggaaaaattgggacataaggtattgcctcttgcaccttattcacctgagctcaacccgattgagaaagtgtgggcgaatattaagcggtatctgcgaaccgttttgtctgattacgcccgatttgacgatgcactactgtcctattttgattttaattgaatattatattcggtttccaactgaccgacccattctgacaaggccgacaggcgttgttcggatttcgccacgaacgggttttcggtatcccacgcgtagcctgccaaaatcgaagaaagcatacggctga

SEQ ID NO: 2254 - protein, 109 aa, Neisseria meningitidis
MRDFTVWVSYGKWRKNWDIRYCLLHLIHLSSTRLRKCGRILSGICEPFCLITPDLTMHYCPILILIEYYIRFPTDRPILTRPTGVVRISPRTGFRYPTRSLPKSKKAYG

SEQ ID NO: 2255 - DNA, 441 bp, Neisseria gonorrhoeae
atgattaaggaaaccctaatgcgcccaatcttcctatctttcgttttactccctattttgataaccgcctgcagcacaccggacaagtctgcccgatgggaaaatatcggcacaatctcaaacggcaatattcatacatatattaataaagacagtgtgagaaaaaacggaaatctgatgattttccaagataaaaaagttgttaccaatctgaaacaagaacgttttgccaacacccccgcatacaagactgccattgccgagtgggaaatccactgcaacaacaaaacataccgcttaagttcgctacagttatttgatacaaaaaacacggaaatttccacacaaaactacacagcctcttccctccgcccgatgagcatcctgtccgggacattaactgaaaaacaatatgaaaccgtatgcgggaaaaaactctga

SEQ ID NO: 2256 - protein, 146 aa, Neisseria gonorrhoeae
MIKETLMRPIFLSFVLLPILITACSTPDKSARWENIGTISNGNIHTYINKDSVRKNGNLMIFQDKKVVTNLKQERFANTPAYKTAIAEWEIHCNNKTYRLSSLQLFDTKNTEISTQNYTASSLRPMSILSGTLTEKQYETVCGKKL

SEQ ID NO: 2257 - DNA, 441 bp, Neisseria meningitidis
atgattaaggaaaccctaatgcgcccaatcttcctatctttcgttttattccctattttgataaccgcctgcagcacaccggacaagtctgcccgatgggaaaatatcggcacaatctcaaacggcaatattcatacatatatcaataaagacagcgtgagaaaaaacggaaatctgatgattttccaagataaaaaagttgttaccaatctaaaacaagaacgttttgccaacacccccgcatacaagactgccattgccgagtgggaaatccactgcaacaacaaaacataccgcttaagttcgctacagttgtttgatacaaaaaacacggaaatttccacacaaaactacacagcctcttccctccgcccgatgagcatcctgtccgggacattaaccgaaaaacaatatgaaaccgtatgcggaaaaaaactctga

SEQ ID NO: 2258 - protein, 146 aa, Neisseria meningitidis
MIKETLMRPIFLSFVLFPILITACSTPDKSARWENIGTISNGNIHTYINKDSVRKNGNLMIFQDKKVVTNLKQERFANTPAYKTAIAEWEIHCNNKTYRLSSLQLFDTKNTEISTQNYTASSLRPMSILSGTLTEKQYETVCGKKL

SEQ ID NO: 2259 - DNA, 441 bp, Neisseria meningitidis
  misc_feature (188)..(188): n is a, c, g, or t
  misc_feature (232)..(232): n is a, c, g, or t
  misc_feature (351)..(351): n is a, c, g, or t
atgattaaggaaaccctaatgcgcccaatcttcctatctttcgttttattccctattttgataaccgcctgcagcacaccggacaagtctgcccgatgggaaaatatcggcacaatctcaaacggcaatattcatacatatatcaataaagacagcgtgagaaaaaacggaaatctgatgattttccnagataaaaaagttgttaccaatctaaaacaagaacgttttgccnacacccccgcatacaagactgccattgccgagtgggaaatccactgcaacaacaaaacataccgcttaagttcgctacaattgtttgatacaaaaaacacggaaatttccacacaaaantacacagcctcttccctccgcccgatgagcatcctgtccgggacattaaccgaaaaacaatatgaaaccgtatgcggaaaaaaactctga

SEQ ID NO: 2260 - protein, 146 aa, Neisseria meningitidis
  misc_feature (63)..(63): Xaa can be any naturally occurring amino acid
  misc_feature (78)..(78): Xaa can be any naturally occurring amino acid
  misc_feature (117)..(117): Xaa can be any naturally occurring amino acid
MIKETLMRPIFLSFVLFPILITACSTPDKSARWENIGTISNGNIHTYINKDSVRKNGNLMIFXDKKVVTNLKQERFAXTPAYKTAIAEWEIHCNNKTYRLSSLQLFDTKNTEISTQXYTASSLRPMSILSGTLTEKQYETVCGKKL

SEQ ID NO: 2261 - DNA, 519 bp, Neisseria gonorrhoeae
atgcgccttttccccatcgccgccgccctgacgcttgccgcctgcggtactgtgcaaagcacacaatatttcgtgttgcccgacagccgctacatccgtcctgcaacgcaaggcggcgaaaccgccgtcgaagtccgtcttgccgaaccgctcaaacgcggcggactggtctatcaaaccgacccctaccgcatcaacaccgcacaaaaccatgtttgggcagacaccttggacgatatgctcgaagcggcgttgagcaatgcattcaaccgtttggacagcacacgcacctttgttcctgcctcacgcagcggcagtaccgacaaatggacggtctatatcgacgcattccaaggcagctacacgggcaaaaccctcatcagcggctacgccgtcctacccgacggtacgaacagacccttccatatcgaaaccgaacagcagggtgacggctacgccgccatgaccgccgcactcgaacagggactgaaacaggcggcgcaacagatggtcgagtaa

SEQ ID NO: 2262 - protein, 172 aa, Neisseria gonorrhoeae
MRLFPIAAALTLAACGTVQSTQYFVLPDSRYIRPATQGGETAVEVRLAEPLKRGGLVYQTDPYRINTAQNHVWADTLDDMLEAALSNAFNRLDSTRTFVPASRSGSTDKWTVYIDAFQGSYTGKTLISGYAVLPDGTNRPFHIETEQQGDGYAAMTAALEQGLKQAAQQMVE

SEQ ID NO: 2263 - DNA, 519 bp, Neisseria meningitidis
atgcgccttttcccgattgccgccgccctgtcgcttgccgcctgcggtactgtgcaaagcacacaatatttcgtgttgcccgacagccgctacatccgtcctgcaacgcaaggcggcgaaactgccgtcgaagtccgtcttgccgaaccgctcaaacgcggcggactggtctatcaaaccgacccctaccgcctcaacaccgcacaaaaccacgtctgggcagacaccttggacgatatgctcgaagcggcgttgagcaatgcattcaaccgtttggacagcacacgcatctttgttcctgcctcacgcagcggcagtaccgaaaaatggacggtctatatcgacgcattccaaggcagctacacgggcaaaaccctcatcagcggctacgccgtcctacccgacggtacgaacagacccttccatatcgaaaccgaacagcagggtgacggctacgccgcgatgaccgccgcactcgaacagggactgaaacaggcggcgcaacagatggtcgagtaa

SEQ ID NO: 2264 - protein, 172 aa, Neisseria meningitidis
MRLFPIAAALSLAACGTVQSTQYFVLPDSRYIRPATQGGETAVEVRLAEPLKRGGLVYQTDPYRLNTAQNHVWADTLDDMLEAALSNAFNRLDSTRIFVPASRSGSTEKWTVYIDAFQGSYTGKTLISGYAVLPDGTNRPFHIETEQQGDGYAAMTAALEQGLKQAAQQMVE

SEQ ID NO: 2265 - DNA, 519 bp, Neisseria meningitidis
atgcgcctcttcccgattgccgccgccctgacgcttgccgcctgcggtactgtgcaaagcacacaatatttcgtgttgcccgacagccgctacatccgtcctgcaacgcaaggcggcgaaactgccgtcgaagtccgtcttgccgaaccgctcaaacgcggcggactggtctatcaaaccgacccctaccgcctcaacaccgcacaaaaccacgtctgggcagacaccttggacgatatgctcgaagcggcgttgagcaatgcattcaaccgtttggacagcacacgcatctttgttcctgcctcacgcagcggcagtaccgaaaaatggacggtctatatcgacgcattccaaggcagctacacgggcaaaaccctcatcagcggctacgccgtcctacccgacggtacgaacagacccttccatatcgaaaccgaacagcagggtgacggctacgccgccatgaccgccgcactcgaacagggactgaaacaggcggcgcaacagatggtcgagtaa

SEQ ID NO: 2266 - protein, 172 aa, Neisseria meningitidis
MRLFPIAAALTLAACGTVQSTQYFVLPDSRYIRPATQGGETAVEVRLAEPLKRGGLVYQTDPYRLNTAQNHVWADTLDDMLEAALSNAFNRLDSTRIFVPASRSGSTEKWTVYIDAFQGSYTGKTLISGYAVLPDGTNRPFHIETEQQGDGYAAMTAALEQGLKQAAQQMVE

SEQ ID NO: 2267 - DNA, 1074 bp, Neisseria gonorrhoeae
ttgttttgccgtatcgggaattttgcgttttgcggcgtggtttctgcaggttgtttgcttaataataaacattcttattcgtatgcaaaggaaccgcacaccgtgaaaccgcgtttttattgggcagcctgcgccgtcctgccggccgcctgttcgcccgaacctgccgccgaaaaaactgtatccgccgcatcccaagccgcatccacacctgtcgccacgctgaccgtgccgaccgcgcggggcgatgccgttgtgccgaagaatcccgaacgcgtcgccgtgtacgactgggcggcgttggatacgctgaccgagccgggcgtgaatgtgggcgcaaccaccgcgccggtgcgcgtggactatttgcagcctgcatttgacaaggcggcaacggtggggacgctgtttgagcccgattgcgaatccctgcaccgccacaatccgcagtttgtcattaccggcgggccgggtgcggaagcgtatgaacagttggcgaaaaacgcgaccaccatagatttgacggtggacaacggcaatatccgcaccagcggcgagaagcagatggagaccctgtcgcggattttcggtaaggaagcgcgcgtggcggaattgaatgcgcagattgacgcgctgttcgcccaaaagcgcgaagccgccaaaggcaaaggacgcgggctggtgctgtcggttacaggcaacaaggtgtccgccttcggcacgcaatcgcggttggcaagttggatacacggcgacatcggcctgccgcccgtggacgaatctttacgcaacgaagggcacgggcagcccgtttccttcgaatacatcaaagagaaaaaccccggctggattttcatcatcgaccgcaccgccgccatcgggcaggaagggccggctgccgtggaagtgttggataacgcgctggtatgcggcacgaacgcttggaagcgcaagcaaatcatcgtcatgcctgccgcgaactacattgtcgcgggcggcgcgcggcagttgatacaggcggcggaacagttgaaggcggcgtttgaaaaggcagaacccgttgcggcgcagtag

SEQ ID NO: 2268 - protein, 357 aa, Neisseria gonorrhoeae
LFCRIGNFAFCGVVSAGCLLNNKHSYSYAKEPHTVKPRFYWAACAVLPAACSPEPAAEKTVSAASQAASTPVATLTVPTARGDAVVPKNPERVAVYDWAALDTLTEPGVNVGATTAPVRVDYLQPAFDKAATVGTLFEPDCESLHRHNPQFVITGGPGAEAYEQLAKNATTIDLTVDNGNIRTSGEKQMETLSRIFGKEARVAELNAQIDALFAQKREAAKGKGRGLVLSVTGNKVSAFGTQSRLASWIHGDIGLPPVDESLRNEGHGQPVSFEYIKEKNPGWIFIIDRTAAIGQEGPAAVEVLDNALVCGTNAWKRKQIIVMPAANYIVAGGARQLIQAAEQLKAAFEKAEPVAAQ

SEQ ID NO: 2269 - DNA, 1068 bp, Neisseria meningitidis
ttgttttgccgtatcgggaattttgcgttttgcggcgtggtttctgcaggttgtttgcttaataataaacattcttattcgtatgcaaaggaaccgcacaccgtgaaaccgcgtttttattgggcagcctgcgccgtcctgctgaccgcctgttcgcccgaacctgccgccgaaaaaactgtatccgccgcatccgcatctgccgccacgctgaccgtgccgaccgcgcggggcgatgccgttgtgccgaagaatcccgaacgcgtcgccgtgtacgactgggcggcgttggatacgctgaccgaattgggcgtgaatgtgggcgcaaccaccgcgccggtgcgcgtggattatttgcagcctgcatttgacaaggcggcaacggtggggacgctgttcgagcccgattacgaagccctgcaccgctacaatcctcagcttgtcattaccggcgggccgggcgcggaagcgtatgaacagttagcgaaaaacgcgaccaccatagatctgacggtggacaacggcaatatccgcaccagcggcgaaaagcagatggagaccttggcgcggattttcggcaaggaagcgcgcgcggcggaattgaaggcgcagattgacgcgctgttcgcccaaacgcgcgaagccgccaaaggcaaaggacgcgggctggtgctgtcggttacgggcaacaaggtgtccgccttcggcacgcagtcgcggttggcaagttggatacacggcgacatcggcctaccgcctgtagacgaatctttacgcaacgaggggcacgggcagcctgtttccttcgaatacatcaaagagaaaaaccccgattggattttcatcatcgaccgtaccgccgccatcgggcaggaagggccggcggctgtcgaagtattggataacgcgctggtacgcggcacgaacgcttggaagcgcaagcaaatcatcgtcatgcctgccgcgaactacattgtcgcgggcggcgcgcggcagttgattcaggcggcggagcagttgaaggcggcgtttaaaaaggcagaacccgttgcggcggggaaaaagtag

SEQ ID NO: 2270 - protein, 355 aa, Neisseria meningitidis
LFCRIGNFAFCGVVSAGCLLNNKHSYSYAKEPHTVKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGARQLIQAAEQLKAAFKKAEPVAAGKK

SEQ ID NO: 2271 - DNA, 1068 bp, Neisseria meningitidis
ttgttttgccgtatcgggaattttgcgttttgcggcgtggtttctgcaggttgtttgcttaataataaacattcttattcgtatgcaaaggaaccgcacaccgtgaaaccgcgtttttattgggcagcctgcgccgtcctgctgaccgcctgttcgcccgaacctgccgccgaaaaaactgtatccgccgcatccgcatctgccgccacactgaccgtgccgaccgcgcggggcgatgccgttgtgccgaagaatcccgaacgcgtcgccgtgtacgactgggcggcgttggatacgctgaccgaattgggtgtgaatgtgggcgcaaccaccgcgccggtgcgcgtggattatttgcagcctgcatttgacaaggcggcaacggtggggacgctgttcgagcccgattacgaagccctgcaccgctacaatcctcagcttgtcattaccggcgggccgggcgcggaagcgtatgaacagttggcgaaaaacgcgaccaccatagatctgacggtggacaacggcaatatccgcaccagcggcgaaaagcagatggagaccttggcgcggattttcggcaaggaagcgcgcgcggcggaattgaaggcgcagattgacgcgctgttcgcccaaacgcgcgaagccgccaaaggcaaaggacgcgggctggtgctgtcggttacgggcaacaaggtgtccgccttcggcacgcagtcgcggttggcaagttggatacacggcgacatcggcctaccgcctgtagacgaatctttacgcaacgaggggcacgggcagcctgtttccttcgaatacatcaaagagaaaaaccccgattggattttcatcatcgaccgtaccgccgccatcgggcaggaagggccggcggctgtcgaagtattggataacgcgctggtacgcggcacgaacgcttggaagcgcaagcaaatcatcgtcatgcctgccgcgaactacattgtcgcgggcggctcgcggcagttgattcaggcggcggagcagttgaaggaggcgtttgaaaaggcagaacccgttgcggcggggaaagagtag

SEQ ID NO: 2272 - protein, 355 aa, Neisseria meningitidis
LFCRIGNFAFCGVVSAGCLLNNKHSYSYAKEPHTVKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGSRQLIQAAEQLKEAFEKAEPVAAGKE

SEQ ID NO: 2273 - DNA, 396 bp, Neisseria gonorrhoeae
aatttctcctgccgcgccgatgatgtttttgacgatatctgcagtgccgttgaaggcttcggcggcattgcccgatctgtccagctcggggctgtatcgggtggcgcgtttgaatccgtcgcctactccttgcgtcagcatagcgccggcattgtggaaacggtcggcaagccgttgtccggtgctgcggttgtcggtcaggttgaggcggatattttgggcaacgccttttatgtcgtagctgtatatatccctcgcgcctttgggagcgggatagccgccgccctgtggcccgtcatagccgtcggcgggatggtgttcgtatccgtcccaatggatgcggtaaaggctgaatccgtcaacgggactaccggcttcgtcagaatcggaatgtga

SEQ ID NO: 2274 - protein, 131 aa, Neisseria gonorrhoeae
NFSCRADDVFDDICSAVEGFGGIARSVQLGAVSGGAFESVAYSLRQHSAGIVETVGKPLSGAAVVGQVEADILGNAFYVVAVYIPRAFGSGIAAALWPVIAVGGMVFVSVPMDAVKAESVNGTTGFVRIGM

SEQ ID NO: 2275 - DNA, 492 bp, Neisseria meningitidis
  misc_feature (85)..(96): n is a, c, g, or t
atgatgttgaaaaaattcgtactcggcggtattgccgcattggttttggcggcctgcggcggttcggaaggcggcagcggagcgnnnnnnnnnnnnaatttctcctgcagcgccgatgatgtttttaacgatatctgcagtgccgttgaaggcttcggcggcattgcccgatctgtccagctcggggctgtatcgggtggcgcgtttgaatccgtcgcctactccttgcgtcagcatactaccggcattgtggaaacggtcggcaagccgttgtccggtgctgcggttgtcggtcaggttgaggcggatattttgggcaacgccttttatgtcgtagctgtatatatccctcgcgcctttgggagcgggatagccgccgccctgtggcccgtcatagccgtcggcgggatggtgttcgtatccgtcccaatggatgcggtaaaggctaaatccgtcaacgggactaccggcttcatcagaatcggaatgtga

SEQ ID NO: 2276 - protein, 163 aa, Neisseria meningitidis
  misc_feature (29)..(32): Xaa can be any naturally occurring amino acid
MMLKKFVLGGIAALVLAACGGSEGGSGAXXXXNFSCSADDVFNDICSAVEGFGGIARSVQLGAVSGGAFESVAYSLRQHTTGIVETVGKPLSGAAVVGQVEADILGNAFYVVAVYIPRAFGSGIAAALWPVIAVGGMVFVSVPMDAVKAKSVNGTTGFIRIGM

SEQ ID NO: 2277 - DNA, 396 bp, Neisseria meningitidis
aatttctcctgccgcgccgatgatgtttttgacgatatctgcagtgccgttgaaagcttcggcggcattgcccgatctgtccagctcggggctgtatcgggtggcgcgtttgaatccgtcgcctactccttgcgtcagcatactaccggtattgtggaaacggtcgacaagccgttgtccggtgctgcggttgtcggtcaggttgaggcggatattttgggcaacgccttttatgtcgtagctgtatatatccctcgcgcctttgggagcgggatagccgccgccctgtggcccgtcatagccgtcggcgggatggtgttcgtatccgtcccaatggatgcggtaaaggctgaatccgtcaacgggactaccggcttcatcagaatcggaatgtga

SEQ ID NO: 2278 - protein, 131 aa, Neisseria meningitidis
NFSCRADDVFDDICSAVESFGGIARSVQLGAVSGGAFESVAYSLRQHTTGIVETVDKPLSGAAVVGQVEADILGNAFYVVAVYIPRAFGSGIAAALWPVIAVGGMVFVSVPMDAVKAESVNGTTGFIRIGM

SEQ ID NO: 2279 - DNA, 705 bp, Neisseria gonorrhoeae
atgaaatccagacacctcgccctcgccctcggcgttgccgccctgttcgcccttgccgcgtgcgacagcaaagtccaaaccagcgtccccgccgacagcgcgcctgccgcttcggcagccgccgccccggcaggactggtcgaagggcaaaactacaccgtccttgccaacccgattccccaacagcaggcaggcaaggttgaagtgcttgagtttttcggctatttttgtccgcactgcgcccgcctcgaacctgttttgagcaaacacgccaagtcttttaaagacgatatgtacctgcgtaccgaacacgtcgtctggcagaaagaaatgctgccgctggcacgcctcgccgccgccgtcgatatggctgccgccgaaagcaaagatgtggcgaacagccatattttcgatgcgatggtcaaccaaaaaatcaagctgcaagagccggaagtcctcaaaaaatggctgggcgaacaaaccgcctttgacggcaaaaaagtccttgccgcctacgaatcccccgaaagtcaggcgcgcgccggcaaaatgcaggagctgaccgaaaccttccaaatcgacggtacgcccacggttatcgtcggcggcaaatataaagtcgaatttgccgactgggagtccggtatgaacaccatcgaccttttggcggacaaagtacgtgaagaacaaaaagccgcgcagtag

SEQ ID NO: 2280 - protein, 234 aa, Neisseria gonorrhoeae
MKSRHLALALGVAALFALAACDSKVQTSVPADSAPAASAAAAPAGLVEGQNYTVLANPIPQQQAGKVEVLEFFGYFCPHCARLEPVLSKHAKSFKDDMYLRTEHVVWQKEMLPLARLAAAVDMAAAESKDVANSHIFDAMVNQKIKLQEPEVLKKWLGEQTAFDGKKVLAAYESPESQARAGKMQELTETFQIDGTPTVIVGGKYKVEFADWESGMNTIDLLADKVREEQKAAQ

SEQ ID NO: 2281 - DNA, 699 bp, Neisseria meningitidis
atgaaatccagacaccttgccctcggcgttgccgccctgttcgcccttgccgcgtgcgacagcaaagtccaaaccagcgtccccgccgacagcgcgcctgccgcttcggcagccgccgccccggcagggctggtcgaagggcaaaactataccgtccttgccaacccgattccccaacagcaggcaggcaaagtcgaagtccttgagtttttcggctatttctgtccgcactgcgcccacctcgaacctgttttaagcaaacacgccaagtcttttaaagacgatatgtacctgcgtaccgaacacgtcgtctggcagaaagaaatgctgacgctggcacgcctcgccgccgccgtcgatatggctgccgccgacagcaaagatgtggcgaacagccatattttcgatgcgatggtcaaccaaaaaatcaagctgcaaaatccggaagtcctcaaaaaatggctgggcgaacaaaccgcctttgacggcaaaaaagtccttgccgcctacgagtcccccgaaagccaggcgcgcgccgacaaaatgcaggagctgaccgaaaccttccaaatcgacggtacgcccacggttatcgtcggcggtaaatataaagttgaatttgccgactgggagtccggtatgaacaccatcgaccttttggcggacaaagtacgcgaagaacaaaaagccgcgcagtaa

SEQ ID NO: 2282 - protein, 232 aa, Neisseria meningitidis
MKSRHLALGVAALFALAACDSKVQTSVPADSAPAASAAAAPAGLVEGQNYTVLANPIPQQQAGKVEVLEFFGYFCPHCAHLEPVLSKHAKSFKDDMYLRTEHVVWQKEMLTLARLAAAVDMAAADSKDVANSHIFDAMVNQKIKLQNPEVLKKWLGEQTAFDGKKVLAAYESPESQARADKMQELTETFQIDGTPTVIVGGKYKVEFADWESGMNTIDLLADKVREEQKAAQ

SEQ ID NO: 2283 - DNA, 699 bp, Neisseria meningitidis
atgaaatccaaacacctcgccctcggcgttgccgccctgttcgcacttgccgcgtgcgacagcaaagtccaaaccagcgtccccgccgacagcgcgcctgccgcttcggcagccgccgccccggcagggctggtcgaagggcaaaactatactgtccttgccaacccgattccccaacagcaggcaggcaaagtcgaagtccttgagtttttcggctatttctgtccgcactgcgcccacctcgaacctgttttaagcaaacacgccaagtcttttaaagacgatatgtacctgcgtaccgaacacgtcgtctggcagaaagaaatgctgacgctcgcacgcctcgccgccgccgtcgatatggctgccgccgacagcaaagatgtggcgaacagccatattttcgatgcgatggtcaaccaaaaaatcaagctgcaagagccggaagtcctcaaaaaatggctgggcgaacaaaccgcctttgacggcaaaaaagtccttgccgcttacgaatctcccgaaagccaggcgcgcgccgacaaaatgcaggagctgaccgaaaccttccaaatcgacggtacgcccacggttatcgtcggcggcaaatataaagtcgaatttgccgactgggagtccggtatgaacaccatcgaccttttggcggacaaagtacgcgaagaacaaaaagccgcgcactaa

SEQ ID NO: 2284 - protein, 232 aa, Neisseria meningitidis
MKSKHLALGVAALFALAACDSKVQTSVPADSAPAASAAAAPAGLVEGQNYTVLANPIPQQQAGKVEVLEFFGYFCPHCAHLEPVLSKHAKSFKDDMYLRTEHVVWQKEMLTLARLAAAVDMAAADSKDVANSHIFDAMVNQKIKLQEPEVLKKWLGEQTAFDGKKVLAAYESPESQARADKMQELTETFQIDGTPTVIVGGKYKVEFADWESGMNTIDLLADKVREEQKAAH

SEQ ID NO: 2285 - DNA, 420 bp, Neisseria gonorrhoeae
gtgctacactagacatcccgatttgcacagaaaggttctcccgtgaacaaaaccctcatcctcgccctttccgccctgttcagcctgaccgcgtgcagcgtcgaacgcgtctcgctgtttccctcctacaaactcaaaatcatccaaggcaacgaactcgaaccgcgcgccgttgccgccctgcgccccggcatgaccaaagaccaagtcctgctcctgctcggcagccccatactgcgcgacgctttccataccgaccgctgggactataccttcaacacctcccgcaacggcatcatcaaagaacgcagcaacctgaccgtctattttgaaaacggcgtactcgtccgcaccgaaggcgacgccctccaaaatgccgccgaagccctccgcgcgaaacaaaacgcagacaaacaataa

SEQ ID NO: 2286 - protein, 138 aa, Neisseria gonorrhoeae
VLHTSRFAQKGSPVNKTLILALSALFSLTACSVERVSLFPSYKLKIIQGNELEPRAVAALRPGMTKDQVLLLLGSPILRDAFHTDRWDYTFNTSRNGIIKERSNLTVYFENGVLVRTEGDALQNAAEALRAKQNADKQ

SEQ ID NO: 2287 - DNA, 420 bp, Neisseria meningitidis
gtgttacactacccatcccgatttgcacagaaaggcatttccgtgaacaaaaccctcatcctcgccctttccgccctcctcggccttgccgcgtgcagtgccgaacgcgtttcactgttcccctcgtacaaactcaaaatcatacagggcaacgaactcgaaccgcgcgccgttgccgccctccgccccggcatgaccaaagaccaagtcctgctcctgctcggcagccccatactgcgcgacgcattccataccgaccgctgggactataccttcaacacctcccgcaacggcatcatcaaagaacgcagcaatctgaccgtctattttgaaaacggcgtactcgtccgcaccgaaggcgacgtcctgcaaaacgctgccgaagccctcaaagaccgccaaaacacagacaaaccataa

SEQ ID NO: 2288 - protein, 139 aa, Neisseria meningitidis
VLHYPSRFAQKGISVNKTLILALSALLGLAACSAERVSLFPSYKLKIIQGNELEPRAVAALRPGMTKDQVLLLLGSPILRDAFHTDRWDYTFNTSRNGIIKERSNLTVYFENGVLVRTEGDVLQNAAEALKDRQNTDKP

SEQ ID NO: 2289 - DNA, 420 bp, Neisseria meningitidis
gtgttacactacccatcccgatttgcacagaaaggcatttccgtgaacaaaaccctcatcctcgccctttccgccctcctcggccttgccgcgtgcagcgtcgaacgcgtttcactgttcccctcgtacaaactcaaaatcatacagggcaacgaactcgaacctcgcgccgtcgcctccctccgccccggtatgaccaaagaccaagtcctgctcctgctcggcagccccatactgcgcgacgcattccataccgaccgctgggactataccttcaacacctcccgcaacggcatcatcaaagaccgaagcaatctgaccgtctattttgaaaacggcgtgctcgtccgcaccgaaggcaacgccctgcaaaatgccgccgaagccctccgcgtaaaacaaaacgcagacaaacaataa

SEQ ID NO: 2290 - protein, 139 aa, Neisseria meningitidis
VLHYPSRFAQKGISVNKTLILALSALLGLAACSVERVSLFPSYKLKIIQGNELEPRAVASLRPGMTKDQVLLLLGSPILRDAFHTDRWDYTFNTSRNGIIKDRSNLTVYFENGVLVRTEGNALQNAAEALRVKQNADKQ

SEQ ID NO: 2291 - DNA, 1200 bp, Neisseria gonorrhoeae
tctccgccccttcctccgatgagcggaaaactgatggcggttttgatggcggtactggtcgcgctgatgccgttttccatcgatgcctacctgcccgcgattcccgaaatggcgcagccgctgaacgcggatatccaccgtatcgaatagagtctgagtttgtttatgttcggcacggcgttcgggcaagtggccggcggcgcggtgtccgacatcaaagggcgcaaacccgtcgccctgaccggtttgattgtatattgccttgccgttgccgccatcgtatttgcttcgagtaccgaacagctccttaacctgcgtgcggtacaggcgttcggcgcaggcatggctgtagtcatcgtcggtgcgatggtgcgcgattattattccggacgcaaagccgcgcagatgtttgcccttatcggcatcattctgatggttgtgccgctggccgcacccatggtcggcgcattgttgcagggattgggcggatggcgggcgattttcgttttcttggcggcgtattcgccggtgctgcccggtttggtacagtatttcctgcccaatcccgccgtcggcggcaaaatcggcagggatgtgttcgggctggtggcggggcggttcaagcgcgtattgaaaacccgtgccgcgatgggttatctgttttttcaggcattcagcttcggttcgatgttcgcctttctgaccgaatcttccttcgtgtaccggcagctctaccacgttacgccgcaccggtacgcatgggtgtttgcactcaacatcatcacgatgatgtttttcagccgcgttaccgcgtggcggcttaaaaccggcgcgcatccgcaaagcatcctgctgcgggggattgtcgtccaatttgccgccaacccgtcccaactcgccgccgtgctgtttttcgggttgcccccgttttggctgccggtcgcgtgcgtgatgttttccgtcggtacgcagggcctggtcggtgcggacacgcaggcatgctttatgtcttatttcaaagaagagggcggcagcgcgaacgccgtgtcgggtgtattccggtccttaatcggcgcgggcgtggtcatggcggcaaccgtgatggcggcaaccatgaccgcgtccgcctcttgcggcattgcgcttttgtggctctgctcgcacaaggcgtggaaggaaaacgaaaaaaagcgaatactt

SEQ ID NO: 2292 - protein, 399 aa, Neisseria gonorrhoeae
SPPLPPMSGKLMAVLMAVLVALMPFSIDAYLPAIPEMAQPLNADIHRIESLSLFMFGTAFGQVAGGAVSDIKGRKPVALTGLIVYCLAVAAIVFASSTEQLLNLRAVQAFGAGMAVVIVGAMVRDYYSGRKAAQMFALIGIILMVVPLAAPMVGALLQGLGGWRAIFVFLAAYSPVLPGLVQYFLPNPAVGGKIGRDVFGLVAGRFKRVLKTRAAMGYLFFQAFSFGSMFAFLTESSFVYRQLYHVTPHRYAWVFALNIITMMFFSRVTAWRLKTGAHPQSILLRGIVVQFAANPSQLAAVLFFGLPPFWLPVACVMFSVGTQGLVGADTQACFMSYFKEEGGSANAVSGVFRSLIGAGVVMAATVMAATMTASASCGIALLWLCSHKAWKENEKKRIL

SEQ ID NO: 2293 - DNA, 1380 bp, Neisseria meningitidis
ttgttaatccactatatcgttccggttcgtccggttttgccggggcttttgttgccgcctgtttgtgccggtgtgttaaaattttccgtttccgcgtattgtgttttccgccgccgggcggtttgtttgcgaatcggacgagaatttatgccttctgcccattatcctgaaatgagcgaaaaactgatggcggttttgatggcgatgctggttacgctgatgccgttttccatcgatgcctacctgcccgcgattcccgaaatggcgcaatcgctgaacgcggatgttcaccgcatcgaacagagtttgagtttgtttatgttcggcacggcgttcggacaggtggtcggcggttcggtgtccgacatcaaagggcgcaaacccgtcgccctgaccggtttgattgtatattgccttgccgttgccgccatcgtatttgtttcgagtgccgaacagctcctcaacctgcgcgtcgtgcaggcattcggtgcgggcatgactgtggtcatcgtcggcgcaatggtgcgcgattattattccggacgcaaagccgcccagatgtttgcccttatcggcatcattttgatggttgtgccgctggtcgcacccatggtcggcgcattgttgcagggcttgggtggctggcaggcgatttttgtttttctggcggcgtattcgctggtgctgctcggtttggtacagtatttcctgcccaagcccgccgtcggcggcaaaatcggacgggacgtgttcgggctggtggcggggcggttcaagcgcgtattgaaaacccgtgctgcgatgggttatctgttttttcaggcattcagcttcggttcgatgttcgcctttctgaccgaatcttccttcgtgtaccagcagctctaccgtgttacgcctcatcaatacgcttgggcgtttgcactcaacatcatcacgatgatgtttttcaaccgcgttaccgcgtggcggctcaaaaccggcgtgcatccgcaaagcatcctgctgtgggggattgtcgtccagtttgccgccaacctgtcccaactcgccgccgtgctgtttttcgggttgcccccgttttggctgctggtcgcgtgcgtgatgttttccgtcggtacgcagggcttggtcggtgcaaacacgcaggcgtgttttatgtcctatttcaaagaagagggcggcagcgcaaacgccgtattgggtgtattccaatctttaatcggcgcgggggtgggtatggcggcgaccttcttgcacgacggttcggcaaccgtgatggcggcaacgatgaccgcgtccacctcttgcggcattgcgcttctgtggctctgctcgcatcgtgcgtggaaagaaaacgggcaaagcgaatacctttaa

SEQ ID NO: 2294 - protein, 459 aa, Neisseria meningitidis
LLIHYIVPVRPVLPGLLLPPVCAGVLKFSVSAYCVFRRRAVCLRIGREFMPSAHYPEMSEKLMAVLMAMLVTLMPFSIDAYLPAIPEMAQSLNADVHRIEQSLSLFMFGTAFGQVVGGSVSDIKGRKPVALTGLIVYCLAVAAIVFVSSAEQLLNLRVVQAFGAGMTVVIVGAMVRDYYSGRKAAQMFALIGIILMVVPLVAPMVGALLQGLGGWQAIFVFLAAYSLVLLGLVQYFLPKPAVGGKIGRDVFGLVAGRFKRVLKTRAAMGYLFFQAFSFGSMFAFLTESSFVYQQLYRVTPHQYAWAFALNIITMMFFNRVTAWRLKTGVHPQSILLWGIVVQFAANLSQLAAVLFFGLPPFWLLVACVMFSVGTQGLVGANTQACFMSYFKEEGGSANAVLGVFQSLIGAGVGMAATFLHDGSATVMAATMTASTSCGIALLWLCSHRAWKENGQSEYL

SEQ ID NO: 2295 - DNA, 1380 bp, Neisseria meningitidis
ttgttaatccactatatcgttccggttcgtccggttttgccggggcttttgttgccgcctgtttgtgccggtgtgttaaaattttccgtttccgcgtattgtgttttccgccgccgggcggtttgtttgcgaatcggacgagaatttatgccttctgcccattatcctgaaatgagcgaaaaactgatggcggttttgatggcgatgctggttacgctgatgccgttttccatcgatgcctacctgcccgcgattcccgaaatggcgcagtcgctgaacgcggatgtccaccgcatcgaacagagcctgagtttgtttatgttcggcacggcgttcggacaggtggtcggcggttcggtgtccgacatcaaagggcgcaaacccgtcgcgctgaccggactggccgtctactgccttgccgttgccgccatcgtatttgcttcgagtgccgaacagctcctcaacctgcgcgtcgtgcaggcattcggtgcgggcatgactgtggtcatcgtcggcgcaatggtgcgcgattattattccggacgcaaagccgcccagatgtttgcccttatcggcatcattttgatggttgtgccgctggtcgcacccatggtcggcgcattgttgcagggcttgggtggctggcaggcgatttttgtttttctggcggcgtattcgctggtgctgctcggtttggtacagtatttcctgcccaagcccgccgtcggcggcaaaatcggcagggatgtgttcgggctggtggctgggcggttcaaacgcgtattgaaaacccgtgccgcgatgggttatctgttttttcaggcattcagcttcggttcgatgttcgcctttctgaccgaatcttccttcgtgtaccagcagctctaccacgttacgccgcaccagtacgcttgggcgtttgcactcaacatcatcacgatgatgtttttcaaccgtattaccgcgtggcggctcaaaaccggcgtgcatccgcaaagcatcctgctgtgggggattgtcgtccagtttgccgccaacctgtcccaactcgccgccgtgctgtttttcgggttgcccccgttttggctgctggtcgcgtgcgtgatgttttccgtcggtacgcagggcttggtcggtgcaaacacgcaggcgtgttttatgtcctatttcaaagaagagggcggcagcgcaaacgccgtattgggtgtattccaatctttaatcggcgcgggggtgggtatggcggcgaccttcttgcacgacggttcggcaaccgtgatggcggcaaccatgaccgcgtctacctcttgcggcattgcgcttttgtggctctgctcgcatcgtgcgtggaaagaaaacgggcaaagcgaatacctttaa

SEQ ID NO: 2296 - protein, 459 aa, Neisseria meningitidis
LLIHYIVPVRPVLPGLLLPPVCAGVLKFSVSAYCVFRRRAVCLRIGREFMPSAHYPEMSEKLMAVLMAMLVTLMPFSIDAYLPAIPEMAQSLNADVHRIEQSLSLFMFGTAFGQVVGGSVSDIKGRKPVALTGLAVYCLAVAAIVFASSAEQLLNLRVVQAFGAGMTVVIVGAMVRDYYSGRKAAQMFALIGIILMVVPLVAPMVGALLQGLGGWQAIFVFLAAYSLVLLGLVQYFLPKPAVGGKIGRDVFGLVAGRFKRVLKTRAAMGYLFFQAFSFGSMFAFLTESSFVYQQLYHVTPHQYAWAFALNIITMMFFNRITAWRLKTGVHPQSILLWGIVVQFAANLSQLAAVLFFGLPPFWLLVACVMFSVGTQGLVGANTQACFMSYFKEEGGSANAVLGVFQSLIGAGVGMAATFLHDGSATVMAATMTASTSCGIALLWLCSHRAWKENGQSEYL

SEQ ID NO: 2297 - DNA, 810 bp, Neisseria gonorrhoeae
atgaaaaacaaaacgtcatcacttcccttatggcttgccgcaatcatgctggccgcgcgttccccgagcaaagaagataaaacgaaagaaaacggcgcatccgccgcttcgtcttccgcgtcatcggcttcttcccaaaccgatttgcaaccggccgcatccgcccctgataacgtcaagcaggcagaaagcgcgccactgtgaaattgcaccggcctgcaccccgccgccggcattggcgatctcatacagcaaatcgccgaacacatcgactcggactgtctgtttgccctttcccataacgaactggaaacccgtttcggcttacccggcggcggctatgacaacatacagcggctgctgtttcccgacatccgccctgaagatcccgactaccatcagaaaatcatgctggcaatcgaagacttgcgttacggaacgcgcaccatcagccggcaggcacaagatgccataatggaacaggaacgccgcctccgagaagcgacgctgatgctgacacagggcagtcaaaaaacccgcggacaaggcgaggaaccgaaacgcgcacgttattttgaagtttcggcaacatctgcctatttgaaccggcacaacaacggacttggcggcaatttccaatacatcggccaattgcccggctatctgaaaatgcacggagaaatgcttgaaaaccaatcactcttccggctgtccaaccgtgaacgcaatcccgacaaaccgtttttagacatccattttgacgaaaatggcaaaatcacgcgtattgtcgtttacgaaaaaaatatctat

SEQ ID NO: 2298 - protein, 269 aa, Neisseria gonorrhoeae
MKNKTSSLPLWLAAIMLAARSPSKEDKTKENGASAASSSASSASSQTDLQPAASAPDNVKQAESAPLNCTGLHPAAGIGDLIQQIAEHIDSDCLFALSHNELETRFGLPGGGYDNIQRLLFPDIRPEDPDYHQKIMLAIEDLRYGTRTISRQAQDAIMEQERRLREATLMLTQGSQKTRGQGEEPKRARYFEVSATSAYLNRHNNGLGGNFQYIGQLPGYLKMHGEMLENQSLFRLSNRERNPDKPFLDIHFDENGKITRIVVYEKNIY

SEQ ID NO: 2299 - DNA, 837 bp, Neisseria meningitidis
atgaaaaacaaaacctcatcacttctcttatggcttaccgcaatcatgctgaccgcgtgttctccgagcaaagacgataaaaccaaagaagtcggtgcatccgctgcttcgtcctccgcgtcatcagctccttcccaaaccgatttgcaaccgaccgcatccgcccctgataacgtcaagcaggcagaaagcgcgccgccgtcaaattgcaccagcctgcaccccgccaccggcattgacgatctcatgcagcaaatcgccgaacacattgactcggactgtctgtttgccctttcccatcacgaactggaaacccgtttcggcttacccgacggtggctatgacaacatacagcggctgctgtttcccgacatccgccctgaagatcccgactaccatcagaaaatcatactggcaattgaagacttgcgttacggaaagcgcacgatcagccggcaggcacaaaatgccttgatggaacaggaacgccgcctccgagaagcgacgctgttgctgatacagggcagtcaagaaacccgcggacaaggcgaggagccgaaacgcacgcgttattttgaagtttcggcaacccctgcctattcgagccggcacaacaacggacttggcggcaatttccaatacatcagccaattgcccggctatctgaaaatacacggagaaatgcttgaaaaccaatcactcttccggctgtccaaccgtgaacgcaatcccgacaaaccgtttttagacatccattttgacgaaaatggcaaaatcacgcgtattgtcgtttacgaaaaaaacatctacttcaatccaaacacggggcgaatataa

SEQ ID NO: 2300 - protein, 278 aa, Neisseria meningitidis
MKNKTSSLLLWLTAIMLTACSPSKDDKTKEVGASAASSSASSAPSQTDLQPTASAPDNVKQAESAPPSNCTSLHPATGIDDLMQQIAEHIDSDCLFALSHHELETRFGLPDGGYDNIQRLLFPDIRPEDPDYHQKIILAIEDLRYGKRTISRQAQNALMEQERRLREATLLLIQGSQETRGQGEEPKRTRYFEVSATPAYSSRHNNGLGGNFQYISQLPGYLKIHGEMLENQSLFRLSNRERNPDKPFLDIHFDENGKITRIVVYEKNIYFNPNTGRI

SEQ ID NO: 2301 - DNA, 846 bp, Neisseria meningitidis
atgaaaaacaaaacctcatcacttctcttatggcttgccgcaatgatgctgaccgcgtgttccccgagcaaagaagataaaacgaaagaaaacggcgcatccgccgcctcgtccacggcatccgccgcttcgtcttccgcgccccaaaccgatttgcaaccggccgcatccgcccctgataacgtcaagcaggcagaaagcgtgccgccgtcaaattgcaccgacctgcaccccgccaccggcattgacgatctcatgcagcaaatcgccgaacacattgactcggactgtctgtttgccctttcccatcacgaactggaaacccgtttcggcttacccggcggcggctatgacaacatacagcggctgctgtttcccgacatccgccctgaagatcccgactaccatcagaaaatcatactggcaattgaagacttgcgttacggaaagcgcacgatcagccggcaggcacaagatgccttgatggaacaggaacgccgcctccgagaagcgacgctgttgctgatacagggcagtcaagaaacccgcggacaaggcgaggagccgaaacgcacgcgttattttgaagtttcggcaacccctgcctattcgagccggcacaacaacggacttggcggcaatttccaatacatcggccaattgcccggctatctgaaaatacacggagaaatgcttgaaaaccaatcactcttccggctgtccaaccgtgaacgcaatcccgacaaaccgtttttagacatccattttgacgaaaatggcaaaatcacgcgtattgtcgtttacgaaaaaaacatctacttcaatccaaacttggggcgaagataa

SEQ ID NO: 2302 - protein, 281 aa, Neisseria meningitidis
MKNKTSSLLLWLAAMMLTACSPSKEDKTKENGASAASSTASAASSSAPQTDLQPAASAPDNVKQAESVPPSNCTDLHPATGIDDLMQQIAEHIDSDCLFALSHHELETRFGLPGGGYDNIQRLLFPDIRPEDPDYHQKIILAIEDLRYGKRTISRQAQDALMEQERRLREATLLLIQGSQETRGQGEEPKRTRYFEVSATPAYSSRHNNGLGGNFQYIGQLPGYLKIHGEMLENQSLFRLSNRERNPDKPFLDIHFDENGKITRIVVYEKNIYFNPNLGRR

SEQ ID NO: 2303 - DNA, 435 bp, Neisseria gonorrhoeae
gtgccgctgcctgctccctgccgttttgccaaacctgccgcctcttttttaagtatggctttgctttcctgccagctttcccacgccgccacggcttatatccccccgaacgattttcaaccgaactgcgacatacgccggctcgggctgacacagggtcagcacaatgagctgcgtaaaatccgcgccgccttcaaaatggcgggcgacagggcgcgtttgaaggttatgcattccgaacacagccgccgccgctctgtcgtcgaaatcatttcttcggatgtttttaatcggaacgaggcgcgcgattatgtcgaaagccgctaccactccagcatggattttgcggtggacgaattggaaatccaacaccgcttcttccatattctcacaccgcaacagcagcaaatgtggctttcttcctgcctcaaataa

SEQ ID NO: 2304 - protein, 144 aa, Neisseria gonorrhoeae
VPLPAPCRFAKPAASFLSMALLSCQLSHAATAYIPPNDFQPNCDIRRLGLTQGQHNELRKIRAAFKMAGDRARLKVMHSEHSRRRSVVEIISSDVFNRNEARDYVESRYHSSMDFAVDELEIQHRFFHILTPQQQQMWLSSCLK

SEQ ID NO: 2305 - DNA, 435 bp, Neisseria meningitidis
gtgccactgcctgctccctgccgttttgccaaacctgccgcctcttttttaagtatggctttgctttcctgtcagctttcccacgccgccacggcttatatccccccgaacgattttcaaccgaactgcgacatacgccgactcgggctgacccaaagtcagcacaatgagctgcgtaaaatccgcaccgccttcaaaatggcgggcgacagggcgcgtttgaaggttatgcattccgaacacagccgccgccggtctgtcgtcgaaatcatttcctcggatgtttttaatcggaacgaggcgcgcgattatgtcgaaagccgctatttgtccggtatggattttgcggtggacgaattggaaatccaacaccggttcttccatatcctcacaccgcaacagcagcaaatgtggctttcttcctgcctcaaataa

SEQ ID NO: 2306 - protein, 144 aa, Neisseria meningitidis
VPLPAPCRFAKPAASFLSMALLSCQLSHAATAYIPPNDFQPNCDIRRLGLTQSQHNELRKIRTAFKMAGDRARLKVMHSEHSRRRSVVEIISSDVFNRNEARDYVESRYLSGMDFAVDELEIQHRFFHILTPQQQQMWLSSCLK

SEQ ID NO: 2307 - DNA, 435 bp, Neisseria meningitidis
  misc_feature (11)..(11): n is a, c, g, or t
gtgccactgcntgctccctgccgttttgccaaacctgccgcctcttttttaagtatggctttgctttcctgccagctttcccacgccgccacggcttatatccccctgaacgattttcaaccgaactgcgacatacgccggctcggactgacacagggtcagcacaatgaactgcgtaaaatccgcgccgccttcaaaatggcgggcgacagggcgcgtttgaaggttatgcattccgaacacagccgccgtcggtctgtcgtcgaaatcatttcctcggatgtttttaatcggaacgaggcgcgcgattatgtcgaaagccgctatttgtccggtatggattttgcggtggacgaattggaaatccaacaccggttcttccatatcctcacaccgcaacagcagcaaatgtggctttcttcctgcctcaaataa

SEQ ID NO: 2308 - protein, 144 aa, Neisseria meningitidis
  misc_feature (4)..(4): Xaa can be any naturally occurring amino acid
VPLXAPCRFAKPAASFLSMALLSCQLSHAATAYIPLNDFQPNCDIRRLGLTQGQHNELRKIRAAFKMAGDRARLKVMHSEHSRRRSVVEIISSDVFNRNEARDYVESRYLSGMDFAVDELEIQHRFFHILTPQQQQMWLSSCLK

SEQ ID NO: 2309 - DNA, 1014 bp, Neisseria gonorrhoeae
gtatcgcacacacgctgtcgctgttcggaatcgatacgccggatttggcggaatggcagggaatggcggattaaaggacaaaaatgccgtctgaacacggatgcggttcagacggcatcattttatacgactgccttatttggctgcgccttcattccatgcggcagggtatttgtagccctcgaagcgtttgtgcgcgtaggctttgaacgcgtcggagttataggcctcggttacgtctttaagccattggctgtctttgtcggcggttttgacggcagaccagttgacataggcaaagctcggctcttggaacagggcttcggtcagcttcatgccgctgcttatggcgtagttgccgttgacgacggcaaaatccacgtcggcgcggctgcgcggcagttgtgcggcttcaagctcgacgattttgatgtttttcaggttttccgcgatgtcggctttggatgcggtcagcggattgatgccgtctttgagtttgatccaacccagttcgttcagcatcaccaaggcgcgtgcgaagttggacgggtcgttgggcgcggatacggtgctgccgtctttgacttcttccagcgatttcagtttgcccggatacagtcccaaaggcgcggtcggcacttggaaggcttcggtgatgtccaggttgtgttcttttttgaaatcgtcaagatagggtttgtgttggaagacgttgatgtccaactcgccctccgccaatgccagattcgggcgcacatagtcggtaaattcgaccaatttgacggtgtagccttttttctccagctcggcttggatttgttctttgaccatatcgccgaagtcgcccacggtcgtgccgaagacgatttcttttttcgccgcgccgttatcggcagaaggggcggcggcagaggctgcgggcgcgctgtctttttgaccgccgcaggctgcgaggatgagcgcgagtgcggcggcggaaagggttttgaagaaggttttcatattttctcctga

SEQ ID NO: 2310 - protein, 337 aa, Neisseria gonorrhoeae
VSHTRCRCSESIRRIWRNGREWRIKGQKCRLNTDAVQTASFYTTALFGCAFIPCGRVFVALEAFVRVGFERVGVIGLGYVFKPLAVFVGGFDGRPVDIGKARLLEQGFGQLHAAAYGVVAVDDGKIHVGAAARQLCGFKLDDFDVFQVFRDVGFGCGQRIDAVFEFDPTQFVQHHQGACEVGRVVGRGYGAAVFDFFQRFQFARIQSQRRGRHLEGFGDVQVVFFFEIVKIGFVLEDVDVQLALRQCQIRAHIVGKFDQFDGVAFFLQLGLDLFFDHIAEVAHGRAEDDFFFRRAVIGRRGGGRGCGRAVFLTAAGCEDERECGGGKGFEEGFHIFS

SEQ ID NO: 2311 - DNA, 1011 bp, Neisseria meningitidis
gtgttgcacacgctttgtcgctgttcggaatcgatacgccggattcggcggaatggcagggaatggcggattaaaggacaaaaatgccgtctgaacacggatacagttcagacggcatcattttatacgactgccttatttggctgcgccttcattccatgcggcaggggatttgtagccctcgaagcgtttgtgcgcgtaggctttgaacgcgtcggagttataggcctcggttacgtctttaagccattggctgtctttgtcggcggttttgacggcagaccagttgacataggcaaagctcggttcttggaacagggcttcggtcagcttcatgccgctgcttatggcgtagttgccgttgacgacggcaaaatccacgtcggcgcggctacgcggcagttgcgcggcttcaagctcgacgattttgatgtttttcaggttctcggcgatgtccgctttggatgcggtcaacggattgatgccgtctttgagtttgatccaacccagttcgtcgagcatcaccaagacgcgggcgaagttggacgggtcgttgggcgcggatacggtgctgccgtctttgacttcttccagcgatttcagcttgcccgggtacagtcccaaaggcgcggtcggcacttggaagacttcggtgatgtccagattgtgttcttttttgaagtcgtcaagatagggtttgtgttggaagacgttgatgtccaactcgccctcagccaatgccagattcgggcgtacatagtcggtaaactcgaccagtttgacggtgtagccttttttctccagctcggcttggatttgttctttgaccatatcgccgaagtcgccgacggtcgtgccgaagacgatttcttttttcgccgcgccgttgtcggcggcggcagaagcggatgcggcgggcgcgctgtctttttgaccgccgcaggcggcgaggatgagcgcgagtgcggcggcggaaagggttttgaagaaggttttcatattttctcctga

SEQ ID NO: 2312 - protein, 336 aa, Neisseria meningitidis
VLHTLCRCSESIRRIRRNGREWRIKGQKCRLNTDTVQTASFYTTALFGCAFIPCGRGFVALEAFVRVGFERVGVIGLGYVFKPLAVFVGGFDGRPVDIGKARFLEQGFGQLHAAAYGVVAVDDGKIHVGAATRQLRGFKLDDFDVFQVLGDVRFGCGQRIDAVFEFDPTQFVEHHQDAGEVGRVVGRGYGAAVFDFFQRFQLARVQSQRRGRHLEDFGDVQIVFFFEVVKIGFVLEDVDVQLALSQCQIRAYIVGKLDQFDGVAFFLQLGLDLFFDHIAEVADGRAEDDFFFRRAVVGGGRSGCGGRAVFLTAAGGEDERECGGGKGFEEGFHIFS

SEQ ID NO: 2313 - DNA, 1011 bp, Neisseria meningitidis
gtgttgcacacgctttgtcgctgttcggaatcgatacgccggattcggcggaatggcagggaatggcggattaaaggacaaaaatgccgtctgaacacggatacggttcagacggcatcattttatacgactgccttatttggctgcgccttcattccatgcggcaggggatttgtagccctcgaagcgtttgtgcgcgtaggctttgaacgcgtcggagttataggcctcggttacgtctttaagccattggctgtctttgtcggcggttttgacggcagaccagttgacataggcaaagctcggttcttggaacagggcttcggtcagcttcatgccgctgcttatggcgtagttgccgttgacgacggcaaaatccacgtcggcgcggctacgcggcagttgcgcggcttcaagctcgacgattttgatgtttttcaggttttcggcaatgtccgctttggatgcggtcagcggattgatgccgtctttgagtttgatccaacccagttcgtcgagcatcaccaagacgcgggcgaagttggacgggtcgttgggcgcggatacggtgctgccgtctttgacttcttccagcgatttcagcttgcccgggtacagtcccaaaggcgcggtcggcacttggaagacttcggtgatgtccagattgtgttcttttttgaagtcgtcaagatagggtttgtgttggaagacgttgatgtccaactcgccctcagccaatgccagattcgggcgcacatagtcggtaaactcgaccagtttgacggtgtagccttttttctccagctcgggttggatttgttctttgaccatatcgccgaagtcgccgacggtcgtgccgaagacgatttcttttttcgccgcgccgttgtcggcggcggcagaagcggatgcggcgggcgcgctatctttttgaccgccgcaggcggcgaggatgagcgcgagtgcggcggcggaaagggttttgaagaaggttttcatattttctcctga

SEQ ID NO: 2314 - protein, 336 aa, Neisseria meningitidis
VLHTLCRCSESIRRIRRNGREWRIKGQKCRLNTDTVQTASFYTTALFGCAFIPCGRGFVALEAFVRVGFERVGVIGLGYVFKPLAVFVGGFDGRPVDIGKARFLEQGFGQLHAAAYGVVAVDDGKIHVGAATRQLRGFKLDDFDVFQVFGNVRFGCGQRIDAVFEFDPTQFVEHHQDAGEVGRVVGRGYGAAVFDFFQRFQLARVQSQRRGRHLEDFGDVQIVFFFEVVKIGFVLEDVDVQLALSQCQIRAHIVGKLDQFDGVAFFLQLGLDLFFDHIAEVADGRAEDDFFFRRAVVGGGRSGCGGRAIFLTAAGGEDERECGGGKGFEEGFHIFS

SEQ ID NO: 2315 - DNA, 1119 bp, Neisseria gonorrhoeae
  misc_feature (1062)..(1063): n is a, c, g, or t
tcggcatttgtgttgcccaaacatccgatgcctgcgttaacgcctgcgtcaacgtttgcacaaatcgggtttggtttcgccctcgcggcgcagctccttgggcaggacgaacacgatgctttcttccgcgccccccccttcgcgcacggtttcatgcccccatccgcgtatggttgccaatacttcccgcaccaacacttcgggcgcggacgcgcctgccgttacgccgactttgcttttgccttcaaaccacgtgcgttgcaggtaggacgcgttgtccaccatatacgcatcgattccgcgcgatgccgccacttcgcgcaggcggttgctgttggacgaattgggcgaaccgaccacaatcacgatgtcgcactgttccgccagctctttgacggcggtttgccggttggtcgtcgcatagcagatgtcttccttgtgcggattgcggatattggggaaacgcgcgttcagcgcggcgatgatgtctttggtttcatcgaccgagagcgtggtttggctgacataggcgagtttgtcggggtttctgacttcgagttttgccacatctccgaccgtttcgaccaaaagcattttgcccggtgcaagctgccccatcgtgccttcgacctcggcgtgccccttatgcccgatcatgatgatttcacagtcttgggcatccagtcgggcgacttccttatgcactttcgtcaccagcgggcaagtcgcatcaaatacccggaaaccgcgctccgccgcttcctgctgcaccgccttcgatacgccgtgtgccgaataaaccagtgtcgcgcccggcggcacttccgccaagtcttcgataaacaccgcgcctttttcgcgcaggttgtccacgacgaatttgttgtggacgacttcgtggcgcacataaaccggcgcgccgaattcttccaaagcacgttcgacaatactgattgcccgatccacaccggcgcagaagccgcgcggattggcaaggatgatggtttttccgttcataagttttgcattccgtgttcagacggcattcacgtttttttgctnnatctttgcgatggacgatattgtcaagcaccgccaacaccgcaccgacgcagataa

SEQ ID NO: 2316 - protein, 372 aa, Neisseria gonorrhoeae
  misc_feature (355)..(355): Xaa can be any naturally occurring amino acid
SAFVLPKHPMPALTPASTFAQIGFGFALAAQLLGQDEHDAFFRAPPFAHGFMPPSAYGCQYFPHQHFGRGRACRYADFAFAFKPRALQVGRVVHHIRIDSARCRHFAQAVAVGRIGRTDHNHDVALFRQLFDGGLPVGRRIADVFLVRIADIGETRVQRGDDVFGFIDRERGLADIGEFVGVSDFEFCHISDRFDQKHFARCKLPHRAFDLGVPLMPDHDDFTVLGIQSGDFLMHFRHQRASRIKYPETALRRFLLHRLRYAVCRINQCRARRHFRQVFDKHRAFFAQVVHDEFVVDDFVAHINRRAEFFQSTFDNTDCPIHTGAEAARIGKDDGFSVHKFCIPCSDGIHVFLLXLCDGRYCQAPPTPHRRR

SEQ ID NO: 2317 - DNA, 1158 bp, Neisseria meningitidis
ttggtttccgcatccggcacacggcaaaaatgccgtctgaagcctgttcagacggcatttgtgttgcccaaacattcaacgcctgcgtcaacgtttgcacaaatcgggtttggtttcgccctcgcggcgcaactctttgggcaggacgaacacaatgctttcttccgcaccctcgccttcgcgtacggtttcgtgcccccatccgcgtatggttgccagtacttcccgcaccaacacttcgggcgcggacgcgcctgccgttacgccgactttgtttttgccctcaaaccatgcgcgttgcaggtagcctgcattatccaccatatacgcatcgattccgcgcgatgccgccacttcgcgcaagcggttgctgttggacgaattgggcgaaccgaccacaatcacgatgtcgcactgttctgccaactctttgacggcggtttgccggttggtcgtcgcatagcagatatcttccttgtgcggattgcggatattggggaaacgcgcgttcagcgcggcgatgatgtctttggtttcatcgaccgagagcgtggtttggctgacataggcgagtttgtcggggtttctgacttcgagttttgccacatctccgaccgtttcgaccaaaagcattttgcccggcgcaagctgccccatcgttccttcgacctcgacgtgccccttatgcccgatcatgatgatttcacagtcttgggcatccagtcgggcgacttccttatgcactttcgtcaccagcgggcaagtcgcatcaaacacgcggaaaccgcgctccgccgcttcttgccgcaccgccttcgatacgccgtgtgccgaataaaccagtgtcgcgcccggcggcacttccgccaagtcttcaataaacaccgcacctttttcacgcaggttgtccacgacgaatttgttgtgaacgacttcgtggcgcacataaatcggcgcgccgaactcttccaaagcacgttcgacaatactgattgcccgatccacaccagcgcagaagccgcgcggattggcaaggatgatggttttctcgttcataagcccggtatttcgttttcagacggcatcaatatttttcttcttgggttttacggtggacgatgttgtccaacaccgccaacaccgcaccgacgcagataa

SEQ ID NO: 2318 - protein, 385 aa, Neisseria meningitidis
LVSASGTRQKCRLKPVQTAFVLPKHSTPASTFAQIGFGFALAAQLFGQDEHNAFFRTLAFAYGFVPPSAYGCQYFPHQHFGRGRACRYADFVFALKPCALQVACIIHHIRIDSARCRHFAQAVAVGRIGRTDHNHDVALFCQLFDGGLPVGRRIADIFLVRIADIGETRVQRGDDVFGFIDRERGLADIGEFVGVSDFEFCHISDRFDQKHFARRKLPHRSFDLDVPLMPDHDDFTVLGIQSGDFLMHFRHQRASRIKHAETALRRFLPHRLRYAVCRINQCRARRHFRQVFNKHRTFFTQVVHDEFVVNDFVAHINRRAELFQSTFDNTDCPIHTSAEAARIGKDDGFLVHKPGISFSDGINIFLLGFYGGRCCPTPPTPHRRR

SEQ ID NO: 2319 - DNA, 1158 bp, Neisseria meningitidis; identical to SEQ ID NO: 2317

SEQ ID NO: 2320 - protein, 385 aa, Neisseria meningitidis; identical to SEQ ID NO: 2318

SEQ ID NO: 2321 - DNA, 918 bp, Neisseria gonorrhoeae
ttgcctcaaactcgtccggcaaggcggcatcatcgccatcgacaatattttgttgaacggaagggtgatgcgcgaagcggcttttgatgcgccgcccagtgtcaaaattctcaaagatttcaatcaaaacctgccgaacgatacgcggattgtccccatcaccctgcccgtcggcgacggtttgaccctgcttctgaaaaaataatgaagaccaaattaccgctttttatcatttggctgtctgtgtctgcctcctgtgcttccgttttacccgttccggagggcagccgaaccgaaatgccgacacaggaaaatgcttcagacggcattccctatcccgttcccactctgcaagaccgtttggactatctggaaggcaaaatcgtccggctgtcgaacgaagtggaaatgttaaacgggaaagtcaaagcattggagcatacgaaaatacacccttccggcaggacatacgtccaaaaactcgacgaccgcaaattgaaagagcattacctcaataccgaaggcggcagcgcatccgcacataccgtcgaaaccgcacaaaacctctacaatcaggcactcaaacactatcaaaacggcaggttttctgccgcagccgccttgttgaagggggcggacggcggagacggcggcagcatcgcgcaacgcagtatgtacctgttgctgcaaagcagggcgcgtatggggaactgtgaatctgtcatcgaaatcggagggcgttacgccaaccgtttcaaagacagcccaaccgcgcccgaagtcatattcaaaatcggcgaatgccaatacaggcttcagcaaaaagacattgcaagggcgacttggcgcagcctgatacagacctatcccggcagcccggcggcaaaacgcgccgccgcagccgtacgcaaacgatag

SEQ ID NO: 2322 - protein, 304 aa, Neisseria gonorrhoeae
LPQTRPARRHHRHRQYFVERKGDARSGFCAAQCQNSQRFQSKPAERYADCPHHPARRRRFDPASEKIMKTKLPLFIIWLSVSASCASVLPVPEGSRTEMPTQENASDGIPYPVPTLQDRLDYLEGKIVRLSNEVEMLNGKVKALEHTKIHPSGRTYVQKLDDRKLKEHYLNTEGGSASAHTVETAQNLYNQALKHYQNGRFSAAAALLKGADGGDGGSIAQRSMYLLLQSRARMGNCESVIEIGGRYANRFKDSPTAPEVIFKIGECQYRLQQKDIARATWRSLIQTYPGSPAAKRAAAAVRKR

SEQ ID NO: 2323 - DNA, 918 bp, Neisseria meningitidis
ttgcctcaaactcgtccgtcaaggcggcatcatcgccatcgacaatattttgctgaacggaagggtgatgcgcgaagcggcttccgatgcgccgcccagcgtcggcatcctcaaagatttcaatcaaaacctgccgaacgacccgcgcatcgtccccatcaccctgcccgtcggcgacggcttgaccctgcttctgaaaaaataatgaagatcaaattaccgctttttatcatttggctgtctgtgtccgcctcctgtgcttccgtttcacccgttccggcaggcagccaaaccgaaatgtcgacacgggaaaatgcttcagacggcattccctatcccgttccgaccttgcaagaccgtttggactatctggaaggcaaaatcgtccggctgtcgaacgaagtggaaaccttaaacggcaaagtcaaagcactggaacacgcaaaaacacattcttccggcagggcatacgtccaaaaactcgacgaccgcaagttgaaagagcattacctcaataccgaaggcggcagcgcatccgcacatactgtcgaaaccgcacaaaacctctacaatcaggcactcaaacactataaaagcggcaagttttctgccgctgcctccctgttgaaaggcgcggacggaggcgacggcggcagcatcgcgcaacgcagtatgtacctgttgctgcaaagcagggcgcgtatgggcaactgcgaatccgtcatcgaaatcggagggcgttacgccaaccgtttcaaagacagcccaaccgcgcctgaagccatgttcaaaatcggcgaatgccaatacaggcttcagcaaaaagacattgcaagggcgacttggcgcagcctgatacagacctatcccggcagcccggcggcaaaacgcgccgccgcagccgtgcgcaaacgatag

SEQ ID NO: 2324 - protein, 305 aa, Neisseria meningitidis
LPQTRPSRRHHRHRQYFAERKGDARSGFRCAAQRRHPQRFQSKPAERPAHRPHHPARRRRLDPASEKIMKIKLPLFIIWLSVSASCASVSPVPAGSQTEMSTRENASDGIPYPVPTLQDRLDYLEGKIVRLSNEVETLNGKVKALEHAKTHSSGRAYVQKLDDRKLKEHYLNTEGGSASAHTVETAQNLYNQALKHYKSGKFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 2325 - DNA, 921 bp, Neisseria meningitidis
ttgcctcaagcttgtccggcaaggcggcatcattgccatcgacaatattttgttgaacggaagggtgatgcgcgaagcggcttccgatgcgccgcccagcgtcggcatcctcaaagattttaatcaaaacctgccgaacgatacgcggattgtccccatcaccctgcccgtcggcgacggtttgaccctgcttctgaaaaaataatgaagaccaaattaccgctttttatcatttggctgtccgtatccgccgcctgttcttcccctgtttcccgcaatattcaggatatgcggctcgaaccgcaggcagaggcaggtagttcggacgctattccctatcccgttcccactctgcaagaccgtttggattatctggaaggcacactcgtccgcctgtcgaacgaagtggaaaccttaaacggcaaagtcaaagcactggagcatgcgaaaacacacccttccagcagggcatacgtccaaaaactcgacgaccgcaagttgaaagagcattacctcaataccgaaggcggcagcgcatccgcacataccgtcgaaaccgcacaaaacctctacaatcaggcactcaaacactataaaagcggcaggttttctgccgctgcctccctgttgaaaggcgcggacggaggcgacggcggcagcatcgcgcaacgcagtatgtacctgttgctgcaaagcagggcgcgtatgggcaactgcgaatccgtcatcgaaatcggagggcgttacgccaaccgtttcaaagacagcccaaccgcgcctgaagccatgttcaaaatcggcgaatgccaatacaggcttcagcaaaaagacattgcaagggcgacttggcgcagcctgatacagacctatcccggcagcccggcggcaaaacgcgccgccgcagccgtgcgcaaacgatag

SEQ ID NO: 2326 - protein, 305 aa, Neisseria meningitidis
LPQACPARRHHCHRQYFVERKGDARSGFRCAAQRRHPQRFSKPAERYADCPHHPARRRRFDPASEKIMKTKLPLFIIWLSVSAACSSPVSRNIQDMRLEPQAEAGSSDAIPYPVPTLQDRLDYLEGTLVRLSNEVETLNGKVKALEHAKTHPSSRAYVQKLDDRKLKEHYLNTEGGSASAHTVETAQNLYNQALKHYKSGRFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 2327 - DNA, 363 bp, Neisseria meningitidis
ttgggttgccggcaggcggcatcccatcatttttgccaaggcaacaaattatttggcggcatctttcattttgtctgccgcttcctgagtcgcgtcggcagctttgttcaaagtatctttagctgcttcagttacagcttctttggcttcagttacagcttcctcggcacttgcctttgcatcagccgcagcatctttgacttggtctttcgcttcttcgacggcagaagcggcagactcggcggcagaagccgcagtgtctttaacatcggactcaacggcttgaaccgcttccttaacctcctgtttggcttcttgcgaacaagctgccaaggcagccgccatcattgcggcaatcaataa

SEQ ID NO: 2328 - protein, 120 aa, Neisseria meningitidis
LGCRQAASHHFCQGNKLFGGIFHFVCRFLSRVGSFVQSIFSCFSYSFFGFSYSFLGTCLCISRSIFDLVFRFFDGRSGRLGGRSRSVFNIGLNGLNRFLNLLFGFLRTSCQGSRHHCGNQ

SEQ ID NO: 2329 - DNA, 363 bp, Neisseria meningitidis; identical to SEQ ID NO: 2327

SEQ ID NO: 2330 - protein, 120 aa, Neisseria meningitidis; identical to SEQ ID NO: 2328

SEQ ID NO: 2331 - DNA, 903 bp, Neisseria gonorrhoeae
atgagcagcctgatgacgttgttttcggtattggtaccgatgtttgccggattttttatccgtgttcccaagccttacctgcccgcttcggacaaggtgctgtcggttttggtgtatgccgtgctgctgctgatcggcgtatcgttgtcgcgcgtggaggatttgggttcgcggttgggcgatatggcgttgacggttctgtggctgtttgtttgtacggtaggggcgaacctgcttgccttggcagtgttgggaaagttgtccccgtggcggatagggggaaaagggaagggcgtttcggtcggcgtgtcgggcagtgtgaggcagctcggatgcgtactgctcggttttgtgtccggcaaattgatgtgcgatatttggatgccgtctgaaaacgcgggtatgtactgcctgatgctgctggtgttcctcatcggcgtacagctcaaaagtagcggcgtatcgttgcggcaggttttgcttaaccggcggggcatccggctgtcggtttggtttatattgtcatctctttcaggcgggctgctgtttgccgcatcggcagatggtgtgtcgtggacgaaaggtttggcgatggcttccggcttcggttggtattccctctcgggtttggtaatgaccgaggcttacggggcggtatggggcagcatcatgctgctgaacgatttggcacgagagctgtttgcactggcatttattccgctgctgatgaagcgttttccggatgcggcggtgggggtcggcggcgcgaccagtatggatttcacattgcccgtaattcagggtgcgggcggtttggaagtcgtgccggtagcggtcagcttcggcgtggtggtcaatatcgccgccccgtttctgatggtggtgttttccacgctgggctga

SEQ ID NO: 2332 - protein, 300 aa, Neisseria gonorrhoeae
MSSLMTLFSVLVPMFAGFFIRVPKPYLPASDKVLSVLVYAVLLLIGVSLSRVEDLGSRLGDMALTVLWLFVCTVGANLLALAVLGKLSPWRIGGKGKGVSVGVSGSVRQLGCVLLGFVSGKLMCDIWMPSENAGMYCLMLLVFLIGVQLKSSGVSLRQVLLNRRGIRLSVWFILSSLSGGLLFAASADGVSWTKGLAMASGFGWYSLSGLVMTEAYGAVWGSIMLLNDLARELFALAFIPLLMKRFPDAAVGVGGATSMDFTLPVIQGAGGLEVVPVAVSFGVVVNIAAPFLMVVFSTLG

SEQ ID NO: 2333 - DNA, 903 bp, Neisseria meningitidis
atggacagcctgatgacgttgctttcggtattgataccgatgtttgccggattttttatccgtgtgcccaagccttacctgcccgctttggataaggtgctatcggtcttggtgtatgctgtgctgctgctgatcggcgtctcgttgtcgcgcgtggaggatttgggttcgcggttggacgatatggcgttgacggttctgtggctgtttgtttgtacggtcggggcgaacctgcttgctttggcagtgttgggaaagttattcccgtggcggataaaggggaaagggaagggcgtttcggtcggcgtgtcgggcagtgtggggcagctcggatgcgtgctgctcggatttgcattcggcaaactgatgcgcgatatttggatgccgtctgaaagcgcgggcatgtattgtctgatgctgctggtgttcctcatcggcgtacagctcaaaagcagcggcgtatcgttgcggcaggttttggtcaaccgcaggggtattcggttgtcggtctggtttatgctttcatctctttcgggcgggctgctgtttgccgcatcgacagacggtgtgtcgtggacgaaaggtttggcgatggcttccggcttcggttggtattccctctcgggtttggtcatgaccgaggcttacggcgcggtatggggcagcatcatgctgctgaacgatttggcacgagagctgtttgcactggcatttatcccgctgctgatgaagcgttttccagatgcggcggtgggggttggcggtgcgaccagtatggattttacattgcccgtgattcagggtgcgggcggtttggaagtcgtgccggtagcggtcagcttcggcgtggtggtcaatatcgccgccccgtttctgatggtggtgttttccgctttgggttga

SEQ ID NO: 2334 - protein, 300 aa, Neisseria meningitidis
MDSLMTLLSVLIPMFAGFFIRVPKPYLPALDKVLSVLVYAVLLLIGVSLSRVEDLGSRLDDMALTVLWLFVCTVGANLLALAVLGKLFPWRIKGKGKGVSVGVSGSVGQLGCVLLGFAFGKLMRDIWMPSESAGMYCLMLLVFLIGVQLKSSGVSLRQVLVNRRGIRLSVWFMLSSLSGGLLFAASTDGVSWTKGLAMASGFGWYSLSGLVMTEAYGAVWGSIMLLNDLARELFALAFIPLLMKRFPDAAVGVGGATSMDFTLPVIQGAGGLEVVPVAVSFGVVVNIAAPFLMVVFSALG

SEQ ID NO: 2335 - DNA, 903 bp, Neisseria meningitidis
  misc_feature (430)..(430): n is a, c, g, or t
atggacagcctgatgacgttgctttcggtattgataccgatgtttgccggattttttatccgtgtgcccaagccttacctgcccgctttggataaggtgctatcggtcttggtgtatgctgtgctgctgctgatcggcgtctcgttgtcgcgcgtggaggatttgggttcgcggttggacgatatggcgttgacggttctgtggctgtttgtttgtacggtcggggcgaacctgcttgctttggcagtgttgggaaagttattcccgtggcggataaaggggaaagggaagggcgtttcggtcggtgtgtcgggcagtgtggggcagctcggatgcgtgctgctcggatttgcatccggcaaactgatgcgcgatatttggatgccgtctgaaaacgcgggtatgtattgtctgatgctgctggtgctcntcatcggcgtacagctcaaaagcagcggcgtatcgttgcggcaggttttggtcaaccgcaggggtattcggttgtcggtctggtttatgctttcatctctttcaggcgggctgctgtttgccgcatcggcagacggtgtgtcgtgggtgaaaggtttggcgatggcttccggcttcggttggtattccctctcgggtttggtgatgaccgaggcttacggcgcggtatggggcagtatcgcgcttttgaacgatttggcacgagagctgttcgcgctggcatttattccgctgctgatgaagcgttttcccgatgcggcagtgggggtcggcggcgcgaccagtatggatttcacattgcccgtgattcggggtgcgggcggcttggaagccgtaccggtagcggtcagcttcggcgtggtggtcaatatcgccgctccgtttctgatggtggtgttttccgctttgggctga

SEQ ID NO: 2336 - protein, 300 aa, Neisseria meningitidis
  misc_feature (144)..(144): Xaa can be any naturally occurring amino acid
MDSLMTLLSVLIPMFAGFFIRVPKPYLPALDKVLSVLVYAVLLLIGVSLSRVEDLGSRLDDMALTVLWLFVCTVGANLLALAVLGKLFPWRIKGKGKGVSVGVSGSVGQLGCVLLGFASGKLMRDIWMPSENAGMYCLMLLVLXIGVQLKSSGVSLRQVLVNRRGIRLSVWFMLSSLSGGLLFAASADGVSWVKGLAMASGFGWYSLSGLVMTEAYGAVWGSIALLNDLARELFALAFIPLLMKRFPDAAVGVGGATSMDFTLPVIRGAGGLEAVPVAVSFGVVVNIAAPFLMVVFSALG

SEQ ID NO: 2337 - DNA, 387 bp, Neisseria gonorrhoeae
atgtcttggcacatattccaagttgcagggataccgaccgcttcgatggcacaatctacgccgtcttcgccgacgatggcgaaaacttgtttggagacgtcgccggaagcggggctgatggtatgggtcgcgcccaactctttcgccggtttcaaacggttttcgtccatatcgcacacgataatggcggcagggctatacagttgggcggtcaacaaggcggacataccgacagggccggcacctgcgatgaatacggtatcgccgggtttcacatcgccgtattgcacgccgatttcgtgggcggtcggtaaagcgtcgctcaacagcagggcgatttcttcgttgacgttgtcgtgcggcggcacgaggctgttgtcggcataa

SEQ ID NO: 2338 - protein, 128 aa, Neisseria gonorrhoeae
MSWHIFQVAGIPTASMAQSTPSSPTMAKTCLETSPEAGLMVWVAPNSFAGFKRFSSISHTIMAAGLYSWAVNKADIPTGPAPAMNTVSPGFTSPYCTPISWAVGKASLNSRAISSLTLSCGGTRLLSA

SEQ ID NO: 2339 - DNA, 387 bp, Neisseria meningitidis
atgtcttggcacatattccatgtagcagggataccgacggcttcgatggcgcaatccacgccgtcttcgccgacgatggcaaagacttgtttggatacttcgccggaagcagggttaatggtatgggtcgcacccaattctttcgccagtttcaaacggttttcgtccatatcgcaaacgatgatggcggcgggactgtacagttgggcggtcaacagggcggacataccgacagggcctgccccagcgatgaatacggtgtcgccgggtttgacatcgccgtattgcacgccgatttcgtgggcggtcggcaaagcgtcgctcaacaacagggcgatttcttcgttgacattatcgggcagcggaacgaggctgttgtcggcataa

SEQ ID NO: 2340 - protein, 128 aa, Neisseria meningitidis
MSWHIFHVAGIPTASMAQSTPSSPTMAKTCLDTSPEAGLMVWVAPNSFASFKRFSSISQTMMAAGLYSWAVNRADIPTGPAPAMNTVSPGLTSPYCTPISWAVGKASLNNRAISSLTLSGSGTRLLSA

SEQ ID NO: 2341 - DNA, 387 bp, Neisseria meningitidis
atgtcttggcacatattccaagttgcagggataccgacggcttcgatcgcgcagtccacgccgtcttcgccgacgatagcggcaacttgcttgcttacatcgccggaagcagggttaatggtatgggttgcgcccaactctttcgccagtttcaaacggttttcgtccatatcgcaaacaatgatggcggcggggctgtacagttgggcggtcggcaaggcggacataccgacaggagcggcacctgcgatgaatacggtgtcgccgggtttgacatcgccgtattgcacgccgatttcgtgtgcggtcggcaaagcgtcgctcaacaacagggcgacttcttcgttgacgttgtcgggcagcggcacgaggctgttgtcggcataa

SEQ ID NO: 2342 - protein, 128 aa, Neisseria meningitidis
MSWHIFQVAGIPTASIAQSTPSSPTIAATCLLTSPEAGLMVWVAPNSFASFKRFSSISQTMMAAGLYSWAVGKADIPTGAAPAMNTVSPGLTSPYCTPISCAVGKASLNNRATSSLTLSGSGTRLLSA

SEQ ID NO: 2343 - DNA, 375 bp, Neisseria gonorrhoeae
atgccgtgttccaaagccagttggacttcgcccggagtggcaacgccgggaatcaggggaatgccgctgttgcggccggctctggcgagggattcgtgcaaacccgggctgatggcgaaaaccgcgcctgcgtcttcgacggctttgagctgttcgggattggttaccgtacctgcgccgatgatggcgttgggcatttctttggcaatcaggcggatggcctcgagtccgacgggggtgcgcaaggtaatttcgagggtggggatgccgccttcgacaagggcgcgggacaaatcgacggcggtgcttaagtcgtcaatcgccatcacaggcacaactgcgccggcggtcaggatttcgcggggggtcagttga

SEQ ID NO: 2344 - protein, 124 aa, Neisseria gonorrhoeae
MPCSKASWTSPGVATPGIRGMPLLRPALARDSCKPGLMAKTAPASSTALSCSGLVTVPAPMMALGISLAIRRMASSPTGVRKVISRVGMPPSTRARDKSTAVLKSSIAITGTTAPAVRISRGVS

SEQ ID NO: 2345 - DNA, 432 bp, Neisseria meningitidis
atgccgtgttccaaagccagttggatttcgcccggggtggcaacaccgggaatcagggggatgccgctgttgtggccggctttggcgagggattcatgcagccccgggctgatggcgaaaaccgcgcctgcgtcttcgacggctttgagctgttcgggattggttaccgtacctgcgccgacgatggcgttgggcacttctttggcaatcaggcggatggcatcgaggccgacaggggtgcgcagggtgatttcgagggtagggatgccgccttcgacaagggcgtgggacaaatcgatggcggtgcttaagtcgtcaatcgccattaccggcacaactgcgccggcggtcaaaatttcgcggggggtcagtttggacatttcggttctccgggtggaatggggtattttattaagatgggacaggttgtag

SEQ ID NO: 2346 - protein, 143 aa, Neisseria meningitidis
MPCSKASWISPGVATPGIRGMPLLWPALARDSCSPGLMAKTAPASSTALSCSGLVTVPAPTMALGTSLAIRRMASRPTGVRRVISRVGMPPSTRAWDKSMAVLKSSIAITGTTAPAVKISRGVSLDISVLRVEWGILLRWDRL

SEQ ID NO: 2347 - DNA, 432 bp, Neisseria meningitidis; identical to SEQ ID NO: 2345

SEQ ID NO: 2348 - protein, 143 aa, Neisseria meningitidis; identical to SEQ ID NO: 2346

SEQ ID NO: 2349 - DNA, 867 bp, Neisseria gonorrhoeae
atgaaagcaaaaatcctgacttccgttgcgctgcttgcctgttccggcagcctgtttgcccaaacgctggcaaccgttaacggtcagaaaatcgacagttccgtcatcgatgcgcaggttgccgcattccgtgcggaaaacagccgtgccgaagacacgccgcaactgcgccaatccctgctggaaaacgaagtggtcaacaccgtggtcgcacaggaagtgaaacgcctgaaactcgaccggtcggcagagtttaaagatgcgcttgccaaattgcgtgccgaagcgaaaaagtcgggcgacgacaagaaaccgtccttcaaaaccgtttggcaggcggtaaaatatggcttgaacggcgaggcatacgcactgcatatcgccaaaacccaaccggtttccgagcaggaagtaaaagccgtttacgacaatatcagcggtttttataaaggcacgcaggaagtccagttgggcgaaatcctgaccgacaaggaagaaaatgcgaaaaaagcggttgccgatttgaaggcgaaaaaaggttttgatgccgttttgaaacaatactcgctcaacgaccgcaccaaacggaccggcgcgccggacggatatgtgccgctgaaagatttggaacagggtgttccgccgctttatcaggcaattaaggacttgaaaaaaggcgaatttacggcaacgccgctgaaaaacggcgatttctacggcgtttattatgtcaacgacagccgcgaggtgaaagtgccttcttttgacgaaatgaaaggacagattgccggcaaccttcaggcggaacggattgaccgtgccgtctgtgcgctgttgggtaaggcaaacatcaaacctgcaaaataa

SEQ ID NO: 2350 - protein, 288 aa, Neisseria gonorrhoeae
MKAKILTSVALLACSGSLFAQTLATVNGQKIDSSVIDAQVAAFRAENSRAEDTPQLRQSLLENEVVNTVVAQEVKRLKLDRSAEFKDALAKLRAEAKKSGDDKKPSFKTVWQAVKYGLNGEAYALHIAKTQPVSEQEVKAVYDNISGFYKGTQEVQLGEILTDKEENAKKAVADLKAKKGFDAVLKQYSLNDRTKRTGAPDGYVPLKDLEQGVPPLYQAIKDLKKGEFTATPLKNGDFYGVYYVNDSREVKVPSFDEMKGQIAGNLQAERIDRAVCALLGKANIKPAK

SEQ ID NO: 2351 - DNA, 867 bp, Neisseria meningitidis
atgaaagcaaaaatcctgacttccgttgcactgcttgcctgttccggcagcctgtttgcccaaacgctggcaaccgtcaacggtcagaaaatcgacagttccgtcatcgatgcgcaggttgccgcattccgtgcggaaaacagccgtgccgaagacacgccgcaactgcgccaatccctgctggaaaacgaagtggtcaataccgtggtcgcacaggaagtgaaacgcctgaaactcgaccggtcggcagagtttaaaaatgcgcttgccaaattgcgtgccgaagcgaaaaagtcgggcgacgacaagaaaccgtccttcaaaaccgtttggcaggcggtaaaatatggcttgaacggcgaggcatacgcattgcatatcgccaaaacccaaccggtttccgagcaggaagtaaaagccgcatatgacaatatcagcggtttttacaaaggtacgcaggaagtccagttgggcgaaatcctgaccgacaaggaagaaaatgcaaaaaaagcggttgccgacttgaaggcgaaaaaaggtttcgatgccgtcttgaaacaatattccctcaacgaccgtaccaaacagaccggtgcgccggtcggatatgtgccgctgaaagatttggaacagggtgttccgccgctttatcaggcaattaaggacttgaaaaaaggcgaatttacggcaacgccgctgaaaaacggcgatttctacggcgtttattatgtcaacgacagccgcgaggtaaaagtgccttcttttgatgaaatgaaaggacagattgcgggcaaccttcaggcggaacggattgaccgtgccgtcggtgcactgttgggcaaggcaaacatcaaacctgcaaaataa

SEQ ID NO: 2352 - protein, 288 aa, Neisseria meningitidis
MKAKILTSVALLACSGSLFAQTLATVNGQKIDSSVIDAQVAAFRAENSRAEDTPQLRQSLLENEVVNTVVAQEVKRLKLDRSAEFKNALAKLRAEAKKSGDDKKPSFKTVWQAVKYGLNGEAYALHIAKTQPVSEQEVKAAYDNISGFYKGTQEVQLGEILTDKEENAKKAVADLKAKKGFDAVLKQYSLNDRTKQTGAPVGYVPLKDLEQGVPPLYQAIKDLKKGEFTATPLKNGDFYGVYYVNDSREVKVPSFDEMKGQIAGNLQAERIDRAVGALLGKANIKPAK

SEQ ID NO: 2353 - DNA, 867 bp, Neisseria meningitidis
atgaaagcaaaaatcctgacttccgttgcactgcttgcctgttccggcagcctgtttgcccaaacgctggcaaccgtcaacggtcagaaaatcgacagttccgtcattgatgcgcaggttgccgcattccgtgcggaaaacagccgtgccgaagacacgccgcaactgcgccaatccctgctggaaaacgaagtggtcaacaccgtggtcgcacaggaagtgaaacgcctgaaactcgaccggtcggcagagtttaaaaatgcgcttgccaaattgcgtgccgaagcgaaaaagtcgggcgacgacaagaaaccgtccttcaaaaccgtttggcaggcggtaaaatatggcttgaacggcgaggcatacgcgctgcatatcgccaaaacccaaccggtttccgagcaggaagtaaaagccgcatatgacaatatcagcggtttttacaaaggtacgcaggaagtccagttgggcgaaatcctgaccgacaaggaagaaaatgcaaaaaaagcggttgccgacttgaaggcgaaaaaaggtttcgatgccgtcttgaaacaatattccctcaacgaccgtaccaaacagaccggtgcgccggtcggatatgtgccgctgaaagatttggaacagggtgttccgccgctttatcaggcaattaaggacttgaaaaaaggcgaatttacggcaacgccgctgaaaaacggcgatttctacggcgtttattatgtcaacgacagccgcgaggtaaaagtgccttcttttgatgaaatgaaaggacagattgcgggcaaccttcaggcggaacggattgaccgtgccgtcggtgcactgttgggcaaggcaaacatcaaacctgcaaaataa

SEQ ID NO: 2354 - protein, 288 aa, Neisseria meningitidis; identical to SEQ ID NO: 2352

SEQ ID NO: 2355 - DNA, 2472 bp, Neisseria meningitidis
atgaaaaaaacctgtttccactgcgggctggacgttcccgaaaacctgcatctgaccgtccgttacgaaaacgaagaccgcgaaacctgctgcgccggttgtcaggcagtcgcacaaagcattattgacgcgggcttgggcagttattacaaacaacgcaccgccgacgcgcaaaaaaccgagctgccgccccaagaaatcctcgaccaaatccgcctgtacgacctgcccgaagtccagtccgactttgtggaaacccacggcggcacgcgcgaggcggttttaatgctcggcggcatcacctgcgccgcctgcgtctggctgatcgaacagcagcttttgcgtacagacggcatcgtccgcatcgacctcaattacagcacgcaccgctgccgcgtcgtctgggacgacggcaaaatccgcctttccgacattctgttgaaaatcaggcagataggctacaccgccgcaccctatgacgcgcaaaaaatcgaagccgccaaccaaaaagaacgcaaacaatacatcgtccgcctcgccgttgccgggctggggatgatgcagacgatgatgttcgcgctgccgacctacctttacggcggcgacatcgaacccgatttcctgcaaatcctccattggggcggctttttaatggtgctgcccgtcgtattctattgcgccgtcccgttttatcaaggcgcgctgcgcgacttgaaaaaccgccgcgtcggcatggatacgccgattaccgtcgccatcatcatgacctttatcgccggcgtttacagccttgcgacaaatgcggggcaggggatgtatttcgaatccatcgcgatgctgctgtttttcctgctgggcggacgctttatggaacacattgcccgccgtaaggcaggcgatgccgccgagaggctggtgaagctgattcctgcgttttgccatcatatgcccgattaccccgatacgcaggaaacctgcgaggcagctgtcgtcaaattgaaggcgggcgatatcgtgctggtcaaaccgggcgaaaccatccccgttgacggcacggtgctggaaggaagcagtgccgtcaacgaatctatgctgaccggcgagagcctgcccgtcgccaaaatgccgtctgaaaaagtaaccgccggcacactcaacacgcaaagccccctgattatacgcaccgaccgcaccggcggcggcacgcgactgtcgcacatcgtccgcctgctcgaccgcgccttagcgcaaaaaccgcgcactgccgagttggcggaacaatacgcctcgtctttcatattcggcgaactcctgcttgccgtccccgtcttcatcggctggacgctgtacgccgacgcgcacaccgcattgtggattaccgtcgccctgctggtcattacctgcccctgcgccttatcgcttgccacgccgaccgcgctggcagcttctaccggtacgctggcgcgcgaaggtattttaatcggcggaaagcaggcaatcgaaaccctcgcccaaaccaccgacatcatcttcgacaaaaccggcacgctgacccaaggcaaacccgccgtccgccgtatctcattgttgagaggcacagacgaagcctttgttctcgcggtggcgcaggctttagaacaacagtccgaacatccccttgcccgcgccatcctcaactgccgcatttcagacggcagcgtccccgacatcgctattaaacaacgcctcaaccgcatcggcgaaggcgtgggcgcgcaactgaccgtcaacggcgaaacacaggtttgggcattgggcagggcatcctatgtcgccgaaatttcaggtaaagaaccgcaaacagaaggcggcggcagcgcggtttacctcggcagtcaaagcggtttccaagccgtgttctacctgcaagacccgctcaaagacagcgcggcggaggcggtgcggcagttggcaggcaaaaacctgacgctgcacattctcagcggcgaccgtgaaaccgccgttgccgaaaccgcacgcgccctgggtgtcgcgcactaccgcgcccaagccatgcccgaggacaaactggaatacgtcaaagccttgcaaaaagaagggaaaaaagtgctgatgataggcgacggcatcaacgacgcgcccgttttggcgcaggcagacgtatccgccgccgcagcgggcgggacggatattgcgagggacggcgcggacattgtgttattgaacgaagatttgcgtaccgtcgcccacctgctcgatcaggcgcggcgcacccgccatattatccggcaaaacctgatatgggcgggcgcgtacaatatcattgccgtaccgcttgccgttttgggctatgtccaaccgtggatagccgcactgggtatgagcttcagttcgctggcggttttgggcaacgccctgcgccttcacaaacgggggaaaatgcagtctgaaaaaatgccgtccgaacaatga

SEQ ID NO: 2356 - protein, 823 aa, Neisseria meningitidis
MKKTCFHCGLDVPENLHLTVRYENEDRETCCAGCQAVAQSIIDAGLGSYYKQRTADAQKTELPPQEILDQIRLYDLPEVQSDFVETHGGTREAVLMLGGITCAACVWLIEQQLLRTDGIVRIDLNYSTHRCRVVWDDGKIRLSDILLKIRQIGYTAAPYDAQKIEAANQKERKQYIVRLAVAGLGMMQTMMFALPTYLYGGDIEPDFLQILHWGGFLMVLPVVFYCAVPFYQGALRDLKNRRVGMDTPITVAIIMTFIAGVYSLATNAGQGMYFESIAMLLFFLLGGRFMEHIARRKAGDAAERLVKLIPAFCHHMPDYPDTQETCEAAVVKLKAGDIVLVKPGETIPVDGTVLEGSSAVNESMLTGESLPVAKMPSEKVTAGTLNTQSPLIIRTDRTGGGTRLSHIVRLLDRALAQKPRTAELAEQYASSFIFGELLLAVPVFIGWTLYADAHTALWITVALLVITCPCALSLATPTALAASTGTLAREGILIGGKQAIETLAQTTDIIFDKTGTLTQGKPAVRRISLLRGTDEAFVLAVAQALEQQSEHPLARAILNCRISDGSVPDIAIKQRLNRIGEGVGAQLTVNGETQVWALGRASYVAEISGKEPQTEGGGSAVYLGSQSGFQAVFYLQDPLKDSAAEAVRQLAGKNLTLHILSGDRETAVAETARALGVAHYRAQAMPEDKLEYVKALQKEGKKVLMIGDGINDAPVLAQADVSAAAAGGTDIARDGADIVLLNEDLRTVAHLLDQARRTRHIIRQNLIWAGAYNIIAVPLAVLGYVQPWIAALGMSFSSLAVLGNALRLHKRGKMQSEKMPSEQ

SEQ ID NO: 2357 - DNA, 717 bp, Neisseria gonorrhoeae
gtgttcaataatttccttgcctctctgccgtttatgacggaaacacgcgctgatatgctcatcagcgcgttttggcccatggttaaagccggctttacagtgtctttgcctttggcgatcgcttctttcgttatcggcatgattattgccgtagccgttgctttggtaagaatcatgccttccggcggtattttccaaaaatgcttgttgaagctggtggaattttatatttccgtcgttcgcggtacgccgctgttggttcagcttgtgattgtgttttacgggctgccgtccgtcggcatctatatcaatccgattcccgccgccatcatcggcttttcgctcaatgtcggcgcatacgcttccgaaaccatacgcgcggcgattttgtccgtgccgaaagggcagtgggaagcaggtttctccatcggtatgacctatatgcagacgttccgccgcatcgtcgcaccgcaggcattccgcgtcgccgttccgccgttgagcaacgagtttatcggcttgttcaaaaacacctcgcttgccgccgtggtaacggtaacggagcttttccgtgtcgcacaggaaacggcaaaccgcacttatgactttttgcctgtctatatcgaagctgcattggtttattggtgtttctgtaaagtgctgtttttgattcaggcgcgtttggaaaaacgtttcgaccgttatgtcgccaaataa

SEQ ID NO: 2358 - protein, 238 aa, Neisseria gonorrhoeae
VFNNFLASLPFMTETRADMLISAFWPMVKAGFTVSLPLAIASFVIGMIIAVAVALVRIMPSGGIFQKCLLKLVEFYISVVRGTPLLVQLVIVFYGLPSVGIYINPIPAAIIGFSLNVGAYASETIRAAILSVPKGQWEAGFSIGMTYMQTFRRIVAPQAFRVAVPPLSNEFIGLFKNTSLAAVVTVTELFRVAQETANRTYDFLPVYIEAALVYWCFCKVLFLIQARLEKRFDRYVAK

SEQ ID NO: 2359 - DNA, 717 bp, Neisseria meningitidis
gtgttcaataatttccttgcttcgctgccgtttatgacggaaacacgcgccgatatgattgtcagcgcgtttttgcctatggtcaaagccggcttcgcggtctctctgcctttggcggcagcttctttcgttatcggtatgatgattgcggtagccgtggctttggtgcggattatgcccgccggcggcatcgtgcggaaaatcctgctgaaattggtggaattttatatttccgtcattcgcggtacgccgctgttggttcagcttgtgattgtgttttacgggctgccttccgtcggcatctatatcgacccgattcctgccgccatcatcggcttttcgctcaatgtcggcgcatacgcttccgaaaccatacgcgcggcaattttgtccgtacctaaaggccaatgggaagcaggtttctccatcggcatgacctatatgcagacgttccgccgcattgtcgcgccgcaggcattccgcgttgccgtgccgcctttgagcaacgagtttatcggtttgtttaaaaacacctcgctcgcggcagtcgtgacggtaacggaattattccgcgtcgcgcaggaaacggcaaaccgcacttatgactttttgcccgtctatatcgaagccgctttggtttactggtgtttttgtaaagtgctgttcctgattcaggcgcgtttggaaaaacgtttcgaccgctacgtcgccaaataa

SEQ ID NO: 2360 - protein, 238 aa, Neisseria meningitidis
VFNNFLASLPFMTETRADMIVSAFLPMVKAGFAVSLPLAAASFVIGMMIAVAVALVRIMPAGGIVRKILLKLVEFYISVIRGTPLLVQLVIVFYGLPSVGIYIDPIPAAIIGFSLNVGAYASETIRAAILSVPKGQWEAGFSIGMTYMQTFRRIVAPQAFRVAVPPLSNEFIGLFKNTSLAAVVTVTELFRVAQETANRTYDFLPVYIEAALVYWCFCKVLFLIQARLEKRFDRYVAK

SEQ ID NO: 2361 - DNA, 717 bp, Neisseria meningitidis
gtgttcaataatttccttgcttcgctgccgtttatgacggaaacacgcgccgatatgattgtcagcgcgtttttgcctatggtcaaagccggcttcgcggtctctctgcctttggcggcagcttctttcgttatcggtatgatgattgcggtagccgtggctttggtgcggattatgcccgccggcggcatcgtgcggaaaatcctgctgaaattggtggaattttatatttccgtcattcgcggtacgccgctgttggttcagcttgtgattgtgttttacgggctgccttccgtcggcatctatatcgacccgattcctgccgccatcatcggcttttcgctcaatgtcggcgcatatgcttccgaaaccatacgcgcggcaattttgtccgtaccgaaaggccaatgggaagcaggtttctccatcggcatgacctatatgcagacgttccgccgcatcgtcgcgccgcaggcatttcgcgttgccgtgccgcctttgagcaacgagtttatcggtttgtttaaaaacacctcgctcgcggcagtcgtgacggtaacggaattattccgcgtcgcgcaggaaacggcaaaccgcacttatgactttttgcccgtctatatcgaagccgctttggtttactggtgtttttgtaaagtgctgttcctgattcaggcgcgtttggaaaaacgtttcgaccgctacgtcgccaaataa

SEQ ID NO: 2362 - protein, 238 aa, Neisseria meningitidis; identical to SEQ ID NO: 2360

SEQ ID NO: 2363 - DNA, 1128 bp, Neisseria gonorrhoeae
atgaactcctcgcaacgcaaacgcctttccggccgctggctcaactcctacgaacgctaccgccaccgccgcctcatacatgccgtgcggctcggcggaaccgtcctgttcgccaccgcactcgcccggctactccacctccaacacggcgaatggatagggatgaccgtcttcgtcgtcctcggcatgctccagttccaaggcgcgatttactccaacgcggtggaacgtatgctcggtacggtcatcgggctgggcgcgggtttgggcgttttatggctgaaccagcattatttccacggcaacctcctcttctacctgaccatcggcacggcaagcgcactggccggctgggcggcggtcggcaaaaacggctacgtccctatgctggcggggctgacgatgtgcatgctcatcggcgacaacggcagcgaatggctcgacagcggcctgatgcgcgcgatgaacgtcctcatcggcgccgccatcgccattgccgccgccaaactgctgccgctgaaatccacactgatgtggcgtttcatgcttgccgacaacctggccgactgcagcaaaatgattgccgaaatcagcaacggcaggcgtatgacgcgcgaacgtttggagcagaatatggtcaaaatgcgccaaatcaacgcacgcatggtcaaaagccgcagccacctcgccgccacatcgggcgaaagccgcatcagcccctccatgatggaagccatgcagcacgcccaccgcaaaatcgtcaacaccaccgagctgctcctgaccaccgccgccaagctgcaatctcccaaactcaacggcagcgaaatccggctgctcgaccgccacttcacactgctccaaaccgacctgcaacaaaccgccgccctcatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacggctga

SEQ ID NO: 2364 - protein, 375 aa, Neisseria gonorrhoeae
MNSSQRKRLSGRWLNSYERYRHRRLIHAVRLGGTVLFATALARLLHLQHGEWIGMTVFVVLGMLQFQGAIYSNAVERMLGTVIGLGAGLGVLWLNQHYFHGNLLFYLTIGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEQNMVKMRQINARMVKSRSHLAATSGESRISPSMMEAMQHAHRKIVNTTELLLTTAAKLQSPKLNGSEIRLLDRHFTLLQTDLQQTAALINGRHARRIRIDTAINPELEALAEHLHYQWQGFLWLSTNMRQEISALVILLQRTRRKWLDAHERQHLRQSLLETREHG

SEQ ID NO: 2365 - DNA, 1128 bp, Neisseria meningitidis
atgaacacctcgcaacgcaaccgcctcgtcagccgctggctcaactcctacgaacgctaccgctaccgccgcctcatccacgccgtccggctcggcggggccgtcctgttcgccaccgcctccgcccggctgctccacctccaacacggcgagtggatagggatgaccgtcttcgtcgtcctcggcatgctccagtttcaaggggcgatttactccaaggcggtggaacgtatgctcggcacggtcatcgggctgggcgcgggtttgggcgttttatggctgaaccagcattatttccacggcaacctcctcttctacctcaccgtcggcacggcaagcgcactggccggctgggcggcggtcggcaaaaacggctacgtccctatgctggcagggctgacgatgtgtatgctcatcggcgacaacggcagcgaatggctcgacagcggactcatgcgcgccatgaacgtcctcatcggcgcggccatcgccatcgccgccgccaaactgctgccgctgaaatccacactgatgtggcgtttcatgcttgccgacaacctggccgactgcagcaaaatgattgccgaaatcagcaacggcaggcgcatgacccgcgaacgcctcgaggagaacatggcgaaaatgcgccaaatcaacgcacgcatggtcaaaagccgcagccatctcgccgccacatcgggcgaaagccgcatcagccccgccatgatggaagccatgcagcacgcccaccgtaaaatcgtcaacaccaccgagctgctcctgaccaccgccgccaagctgcaatctcccaaactcaacggcagcgaaatccggctgcttgaccgccacttcacactgctccaaaccgacctgcaacaaaccgtcgcccttatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacggctga

SEQ ID NO: 2366 - protein, 375 aa, Neisseria meningitidis
MNTSQRNRLVSRWLNSYERYRYRRLIHAVRLGGAVLFATASARLLHLQHGEWIGMTVFVVLGMLQFQGAIYSKAVERMLGTVIGLGAGLGVLWLNQHYFHGNLLFYLTVGTASALAGWAAVGKNGYVPMLAGLTMCMLIGDNGSEWLDSGLMRAMNVLIGAAIAIAAAKLLPLKSTLMWRFMLADNLADCSKMIAEISNGRRMTRERLEENMAKMRQINARMVKSRSHLAATSGESRISPAMMEAMQHAHRKIVNTTELLLTTAAKLQSPKLNGSEIRLLDRHFTLLQTDLQQTVALINGRHARRIRIDTAINPELEALAEHLHYQWQGFLWLSTNMRQEISALVILLQRTRRKWLDAHERQHLRQSLLETREHG

SEQ ID NO: 2367 - DNA, 1128 bp, Neisseria meningitidis
atgaacacctcgcaacgcaaccgcctcgtcagccgctggctcaactcctacgaacgctaccgctaccgccgcctcatccacgccgtccggctcggcggggccgtcctgttcgccaccgcctccgcccggctgctccacctccaacacggcgagtggatagggatgaccgtcttcgtcgtcctcggcatgctccagtttcaaggggcgatttactccaaggcggtggaacgtatgctcggcacggtcatcgggctgggcgcgggtttgggcgttttatggctgaaccagcattatttccacggcaacctcctcttctacctcaccgtcggcacggcaagcgcactggccggctgggcggcggtcggcaaaaacggctacgtccctatgctggcggggctgacgatgtgcatgctcatcggcgacaacggcagcgaatggttcgacagcggcctgatgcgcgcgatgaacgtcctcatcggcgcggccatcgccatcgccgccgccaaactgctgccgctgaaatccacactgatgtggcgtttcatgcttgccgacaacctgaccgactgcagcaaaatgattgccgaaatcagcaacggcaggcgcatgacccgcgaacgcctcgaagagaacatggcgaaaatgcgccaaatcaacgcacgcatggtcaaaagccgcagccacctcgccgccacatcgggcgaaagccgcatcagccccgccatgatggaagccatgcagcacgcccaccgtaaaattgtcaacaccaccgagctgctcctgaccaccgccgccaagctgcaatctcccaaactcaacggcagcgaaatccggctgcttgaccgccacttcacactgctccaaaccgacctgcaacaaaccgtcgcccttatcaacggcagacacgcccgccgcatccgcatcgacaccgccatcaaccccgaactggaagccctcgccgaacacctccactaccaatggcagggcttcctctggctcagcaccaatatgcgtcaggaaatttccgccctcgtcatcctgctgcaacgcacccgccgcaaatggctggatgcccacgaacgccaacacctgcgccaaagcctgcttgaaacacgggaacacagttga

SEQ ID NO: 2368 - protein, 375 aa, Neisseria meningitidis
MNTSQRNRLVSRWLNSYERYRYRRLIHAVRLGGAVLFATASARLLHLQHGEWIGMTVFVVLGMLQFQGAIYSKAVERMLGTVIGLGAGLGVLWLNQHYFHGNLLFYLTVGTASALAGWAAVGKNGYVPMLAGLTMCMLIGDNGSEWFDSGLMRAMNVLIGAAIAIAAAKLLPLKSTLMWRFMLADNLTDCSKMIAEISNGRRMTRERLEENMAKMRQINARMVKSRSHLAATSGESRISPAMMEAMQHAHRKIVNTTELLLTTAAKLQSPKLNGSEIRLLDRHFTLLQTDLQQTVALINGRHARRIRIDTAINPELEALAEHLHYQWQGFLWLSTNMRQEISALVILLQRTRRKWLDAHERQHLRQSLLETREHS

SEQ ID NO: 2369 - DNA, 1680 bp, Neisseria meningitidis
atggaaattattaacgatgcagaacttatccgttccatgcagcgtcagcagcacatagatgctgaattgttaactgatgcaaatgtccgtttcgagcaaccattggagaagaacaattatgtcctgagtgaagatgaaacaccgtgtactcgggtaaattacattagtttagatgataagacggtgcgcaaattttcttttcttccttctgtgctcatgaaagaaacagcttttaaaactgggatgtgtttaggttccaataatttgagcaggctacaaaaagccgcgcaacagatactgatcgtgcgtggctacctcacttcccaagctattatccaaccacagaatatggattcgggaattctgaaattacgggtatcagcaggcgaaataggggatatccgctatgaagaaaaacgggatgggaagtctgccgagggcagtattagtgcattcaataacaaatttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggcgcacaaaacggacttgactgatgccaccggtacggaaactgaaagcggatccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacagacttcataaaacttcagtcggaatgaaattatggacacgccaaacctataaatacatcgacgatgccgaaatcgaagtacaacgccgccgctctgcaggctgggaagccgaattgcgccaccgtgcttacctcaaccgttggcagcttgacggcaagttgtcttacaaacgcgggaccggcatgcgccaaagtatgcctgcaccggaagaaaacggcggcgatattcttccaggtacatctcgtatgaaaatcattactgccagtttggacgcagccgccccatttattttaggcaaacagcagtttttctacgcaaccgccattcaagctcaatggaacaaaacgccgttggttgcccaagataaattgtcaatcggcagccgctacaccgttcgcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggcttcagaggagggcataaagtaggcggtatgtttgcttatgatctgtttgccggcaagccgcttcataaacccaaaggctttcagacgaccaacaccgtttacggcttcaacttgaattacagtttctaa

SEQ ID NO: 2370 - protein, 559 aa, Neisseria meningitidis
MEIINDAELIRSMQRQQHIDAELLTDANVRFEQPLEKNNYVLSEDETPCTRVNYISLDDKTVRKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLAHKTDLTDATGTETESGSRSYSVHYSVPVKKWLFSFNHNGHRYHEATEGYSVNYDYNGKQYQSSLAAERMLWRNRLHKTSVGMKLWTRQTYKYIDDAEIEVQRRRSAGWEAELRHRAYLNRWQLDGKLSYKRGTGMRQSMPAPEENGGDILPGTSRMKIITASLDAAAPFILGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 2371 - DNA, 1464 bp, Neisseria meningitidis
  misc_feature (1)..(1): n is a, c, g, or t
  misc_feature (180)..(180): n is a, c, g, or t
  misc_feature (209)..(209): n is a, c, g, or t
  misc_feature (250)..(250): n is a, c, g, or t
  misc_feature (485)..(485): n is a, c, g, or t
  misc_feature (501)..(501): n is a, c, g, or t
  misc_feature (512)..(512): n is a, c, g, or t
  misc_feature (563)..(563): n is a, c, g, or t
  misc_feature (622)..(623): n is a, c, g, or t
  misc_feature (757)..(762): n is a, c, g, or t
  misc_feature (765)..(765): n is a, c, g, or t
  misc_feature (770)..(770): n is a, c, g, or t
  misc_feature (772)..(772): n is a, c, g, or t
  misc_feature (784)..(784): n is a, c, g, or t
  misc_feature (898)..(898): n is a, c, g, or t
  misc_feature (998)..(998): n is a, c, g, or t
  misc_feature (1001)..(1001): n is a, c, g, or t
  misc_feature (1049)..(1049): n is a, c, g, or t
ntgaaagaaacagcttttaaaactgggatgtgtttaggttccaataatttgagcaggctacaaaaagccgcgcaacagatactgattgtgcgtggctacctcacttcccaagctattatccaaccacagaatatggattcgggaattctgaaattacgggtatcagcaggcgaaataggngatatccgctatgaagaaaaacgggatgngaagtctgccgagggcagtattagtgcattcaataacaaanttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgtncgataaccctttgggnttaagcgattngttttatgtttcatatggacgcggtttggtgcacaaaacggacttgactgntgccaccggtacggaaactgaaagcggatccagaagttacagcgtgcattattcggtgnncgtaaaaaaatggctgttttcttttaatcacaatggacatcgttaccacgaagcaaccgaaggctattccgtcaattacgattacaacggcaaacaatatcagagcagcctggccgccgagcgcatgctttggnnnnnnagntttcntnaaacttcagtcngaatgaaattatggacacgccaaacctataaatacatcgacgatgccgaaatcgaagtgcaacgccgccgctctgcaggctgggaagccgaattgcgccaccgtgcttacctcnaccgttggcagcttgacggcaagttgtcttacaaacgcgggaccggcatgcgccaaagtatgcccgcacctgaagaaaacggcggcggtactattccagncanatcccgtatgaaaatcataaccgccggattggatgcagcggccccgtntatgttgggcaaacagcagtttttctacgcaaccgccattcaagctcaatggaacaaaacgcctttggttgcccaagacaagttgtctatcggcagccgctacaccgttcgcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggcttcagaggagggcataaagtaggcggtatgtttgcttatgatctgtttgccggcaagccgcttcataaacccaaaggctttcagacgaccaacaccgtttacggcttcaacttgaattacagtttctaa

SEQ ID NO: 2372 - protein, 487 aa, Neisseria meningitidis
  misc_feature (1)..(1): Xaa can be any naturally occurring amino acid
  misc_feature (70)..(70): Xaa can be any naturally occurring amino acid
  misc_feature (84)..(84): Xaa can be any naturally occurring amino acid
  misc_feature (162)..(162): Xaa can be any naturally occurring amino acid
  misc_feature (171)..(171): Xaa can be any naturally occurring amino acid
  misc_feature (188)..(188): Xaa can be any naturally occurring amino acid
  misc_feature (208)..(208): Xaa can be any naturally occurring amino acid
  misc_feature (253)..(255): Xaa can be any naturally occurring amino acid
  misc_feature (257)..(258): Xaa can be any naturally occurring amino acid
  misc_feature (262)..(262): Xaa can be any naturally occurring amino acid
  misc_feature (300)..(300): Xaa can be any naturally occurring amino acid
  misc_feature (333)..(334): Xaa can be any naturally occurring amino acid
  misc_feature (350)..(350): Xaa can be any naturally occurring amino acid
XKETAFKTGMCLGSNNLSRLQKAAQQILIVRGYLTSQAIIQPQNMDSGILKLRVSAGEIGDIRYEEKRDXKSAEGSISAFNNKXPLYRNKILNLRDVEQGLENLRRLPSVKTDIQIIPSEEEGKSDLQIKWQQNKPIRFSIGIDDAGGKTTGKYQGNVALSXDNPLGLSDXFYVSYGRGLVHKTDLTXATGTETESGSRSYSVHYSVXVKKWLFSFNHNGHRYHEATEGYSVNYDYNGKQYQSSLAAERMLWXXXFXXTSVXMKLWTRQTYKYIDDAEIEVQRRRSAGWEAELRHRAYLXRWQLDGKLSYKRGTGMRQSMPAPEENGGGTIPXXSRMKIITAGLDAAAPXMLGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 2373 - DNA, 762 bp, Neisseria gonorrhoeae
atgccttttaagccatccaaacgaatctctttattacttgttcttgccttgggcgcgtgcagcacttcctaccgcccctcgcgggcagaaaaagccaatcaggtttccaatatcaaaacccagttggcgatggaatatatgcgcggtcaggactaccgtcaggcaacggcaagtattgaagatgccttgaaatcgaaccctaaaaacgaacttgcctggctggtccgtgccgaaatctatcaatacctgaaagttaacgacaaggcgcaggaaagtttccggcaagccctctccatcaaacccgacagtgccgaaatcaacaacaactacggctggttcctgtgcggcaggctcaaccgccctgccgaatctatggcatatttcgacaaagccctggccgaccccacctacccgaccccttatattgccaacctgaataaaggtatatgcagcgcaaaacaggggcaattcggattggcggaagcctatttgaaacgttccctcgccgcccagccgcagttcccacccgcatttaaagaactggcgcgcaccaaaatgctggccgggcagttgggcgatgccgattactactttaaaaaataccaaagcagggtagaagtccttcaggccgatgatttgctgctaggctggaaaattgccaaagccctcggcaacgtgcaggcggcatacgaatatgaagcacaattgcaggcaaatttcccctactcggaagaattgcaaaccgtcctcaccggtcaataa

SEQ ID NO: 2374 - protein, 253 aa, Neisseria gonorrhoeae
MPFKPSKRISLLLVLALGACSTSYRPSRAEKANQVSNIKTQLAMEYMRGQDYRQATASIEDALKSNPKNELAWLVRAEIYQYLKVNDKAQESFRQALSIKPDSAEINNNYGWFLCGRLNRPAESMAYFDKALADPTYPTPYIANLNKGICSAKQGQFGLAEAYLKRSLAAQPQFPPAFKELARTKMLAGQLGDADYYFKKYQSRVEVLQADDLLLGWKIAKALGNVQAAYEYEAQLQANFPYSEELQTVLTGQ

SEQ ID NO: 2375 - DNA, 762 bp, Neisseria meningitidis
atgccttttaagccatccaaacgaatctctttattactcgttcttgccttgggcgcgtgcagcacttcctaccgcccctcgcgggcagaaaaagccaatcaggtttccaatatcaaaacccagttggcaatggaatatatgcgcggtcaggactaccgtcaggcgacggcaagtattgaagacgccctgaaatcggaccctaaaaacgagcttgcctggctggtccgtgccgaaatctatcaatacctgaaagttaacgacaaggcgcaggaaagtttccggcaagccctctccatcaaacccgacagtgccgaaatcaacaacaactacggttggttcctatgcggcaggctcaaccgccctgccgaatctatggcatatttcgacaaagctctggccgaccccacctacccgaccccttatattgccaacctgaataaaggcatatgcagcgcaaaacaggggcaattcggattggcggaagcctatttgaaacgttccctcgccgcccagccgcagttcccacccgcatttaaagaactggcgcgcaccaaaatgctggccgggcagttgggcgatgccgattactactttaaaaaataccaaagcagggtagaagtccttcaggccgatgatttgctgctaggctggaaaattgccaaagccctcggcaacgcacaggcggcatacgaatatgaagcacaattgcaggcgaatttcccctactcggaagaattgcaaaccgtcctcaccggtcaataa

SEQ ID NO: 2376 - protein, 253 aa, Neisseria meningitidis
MPFKPSKRISLLLVLALGACSTSYRPSRAEKANQVSNIKTQLAMEYMRGQDYRQATASIEDALKSDPKNELAWLVRAEIYQYLKVNDKAQESFRQALSIKPDSAEINNNYGWFLCGRLNRPAESMAYFDKALADPTYPTPYIANLNKGICSAKQGQFGLAEAYLKRSLAAQPQFPPAFKELARTKMLAGQLGDADYYFKKYQSRVEVLQADDLLLGWKIAKALGNAQAAYEYEAQLQANFPYSEELQTVLTGQ

SEQ ID NO: 2377 - DNA, 762 bp, Neisseria meningitidis
  misc_feature (164)..(164): n is a, c, g, or t
  misc_feature (287)..(287): n is a, c, g, or t
  misc_feature (331)..(331): n is a, c, g, or t
  misc_feature (408)..(408): n is a, c, g, or t
  misc_feature (416)..(416): n is a, c, g, or t
atgccttttaagccatccaaacgaatctctttattacttgtccttgccttgggcgcgtgcagcacttcctaccgcccctcgcgggcagaaaaagccaatcaggtttccaatatcaaaacccagttggcaatggaatatatgcgcggtcaggactaccgtcaggngacggcaagtattgaagacgccttgaaatcagaccctaaaaacgagcttgcctggctggtccgtgccgaaatctatcaatacctgaaagttaacgacaaggcgcaggaaagtttccggcaagncctctccatcaaacccgacagtgccgaaatcaacaacaactacngctggttcctgtgcggcaggctcaaccgccctgccgaatctatggcatatttcgacaaagccctggccgaccccacntacccgancccttatattgccaacctgaataaaggcatatgcagcgcaaaacaggggcaattcggattggcggaagcctatttgaaacgttccctcgccgcccagccgcagttcccacccgcatttaaagaactggcgcgcaccaaaatgctggccgggcagttgggcgatgccgattactactttaaaaaataccaaagcagggtagaagtccttcaggccgatgatttgctgctaggctggaaaattgccaaagccctcggcaacgcacaggcggcatacgaatatgaagcacaattgcaggcgaatttcccctactcggaagaattgcaaaccgtcctcatcggtcaataa

SEQ ID NO: 2378 - protein, 253 aa, Neisseria meningitidis
  misc_feature (55)..(55): Xaa can be any naturally occurring amino acid
  misc_feature (96)..(96): Xaa can be any naturally occurring amino acid
  misc_feature (111)..(111): Xaa can be any naturally occurring amino acid
  misc_feature (139)..(139): Xaa can be any naturally occurring amino acid
MPFKPSKRISLLLVLALGACSTSYRPSRAEKANQVSNIKTQLAMEYMRGQDYRQXTASIEDALKSDPKNELAWLVRAEIYQYLKVNDKAQESFRQXLSIKPDSAEINNNYXWFLCGRLNRPAESMAYFDKALADPTYPXPYIANLNKGICSAKQGQFGLAEAYLKRSLAAQPQFPPAFKELARTKMLAGQLGDADYYFKKYQSRVEVLQADDLLLGWKIAKALGNAQAAYEYEAQLQANFPYSEELQTVLIGQ

SEQ ID NO: 2379 - DNA, 1380 bp, Neisseria gonorrhoeae
atgtttgctttcaaatccttactcgatatgccgcgcggtgaggcacttgccgtcgtcgtcgctctgattgccgcaatgggctataccatcatttcattggagtggctgccgcatatgtccattattgccgccatcgtcgtgctgattttgtacggcttggcgcgcggtttgaaatacaacgatatgcaggcagggatgataggcgcgttgaatcagggtatgggcgcggtttacctgtttttcttcatcgggctgatggtcagcgcgctgatgatgagcggcgcgattccgacgctgatgtattacggtttcgggctgatttccccgacttatttttatttttccgccttcgcgctgtgttccgtcatcggcgtgtccatcggcagcagcctgaccgcctgcgccactgtcggcgttgcctttatggggatggcggcggcgtttcaggccgatatggcgatgacggcgggcgcgattgtttccggtgtgtttttcggcgataaaatgtccccgctttccgacaccacgggcatttccgcgtccatcgtcggtatcgacctgtttgaacacatcaaaaacatgatgtacaccaccatccctgcgtggcttatcagcgcggcactgatgctttggcttcttcccagcgtcgccgcgcaggatttgaacagcgtcgaatccttccgcagccagcttgaagccacgggattggtgcacggctattcgctgattccgtttgcactgttggtcgttttggcattgatgcgcgtcaatgccgtggtcgccatgctctttaccgtcattgccgccgttgccgtaacgtatctgcacagcacgcccgatctgcgtcagctcggcgcgtggttttatggcggctacaaactcgaaggcgaagcgtttaaagacattgccaaactgatttcgcgcggcggcttggagagtatgttctttacgcagaccatcgttatcctcggtatgagtttgggcgggctgctgtttgcgctcggtgtgattccttccttgctggaggccgtccgtaccttcttgacgaatgccggacgcgcgacgttcagcgttgccatgacttcggtcggggtcaatttcctgattggagagcaatatttgagcatcctgctttcgggagaaacgttcaaacccgtttacgacaaactcggcctgcattcgtgcaacctgtcgcggactctggaagatgcggggacggtgattaacccgctcgtgccgtggagcgtgtgcggcgtatttatcagccacgcccttggcgtacccgtttgggaatatctgccttatgcctttttctgctatttgagtttggctttaaccctgttattcggctggacggggctgactttgagcaaaaaataa

SEQ ID NO: 2380 - protein, 459 aa, Neisseria gonorrhoeae
MFAFKSLLDMPRGEALAVVVALIAAMGYTIISLEWLPHMSIIAAIVVLILYGLARGLKYNDMQAGMIGALNQGMGAVYLFFFIGLMVSALMMSGAIPTLMYYGFGLISPTYFYFSAFALCSVIGVSIGSSLTACATVGVAFMGMAAAFQADMAMTAGAIVSGVFFGDKMSPLSDTTGISASIVGIDLFEHIKNMMYTTIPAWLISAALMLWLLPSVAAQDLNSVESFRSQLEATGLVHGYSLIPFALLVVLALMRVNAVVAMLFTVIAAVAVTYLHSTPDLRQLGAWFYGGYKLEGEAFKDIAKLISRGGLESMFFTQTIVILGMSLGGLLFALGVIPSLLEAVRTFLTNAGRATFSVAMTSVGVNFLIGEQYLSILLSGETFKPVYDKLGLHSCNLSRTLEDAGTVINPLVPWSVCGVFISHALGVPVWEYLPYAFFCYLSLALTLLFGWTGLTLSKK

SEQ ID NO: 2381 - DNA, 1380 bp, Neisseria meningitidis
atgttcgctttcaaatccttactcgatatgccgcgcggtgaggcacttgccgtcgtcgtcgctctgattgccgcgatgggctataccatcatttcattggagtggttgccgcatatgtccattattgccgccatcgtcgtgctgattttgtacggcttggcgcgcggtttgaaatacaacgatatgcagcagggcatgataggcgcgttgaatcagggtatgggcgcgatttacctgtttttcttcatcgggctgatggtcagcgcgctgatgatgagcggcgcgattccgacgctgatgtattacggtttcggactgatttccccgacttatttttatttttcctccttcgcgctgtgttccgtcatcggcgtgtccatcggcagcagcctgaccacctgcgccactgtcggcgttgcctttatggggatggcggcggcgtttcaggccgatatggcgatgacggcgggcgcgattgtttcgggcgcattttttggcgacaaaatgtccccgctttcggatacgacgggtatttccgcgtccatcgtcggcatcgacttgtttgagcacatcaaaaatatgatgtacaccaccatccccgcgtggctcattagtgcggcactgatgctttggcttttgccgaatgtcgccgcgcaggatttgaacagcgtcgaatccttccgcagccagcttgaagccacgggattggtgcacggctattcgctgattccgtttgcgctgttggtcattttggcattgatgcgcatcaacgccgtcgtcgccatgctctttaccgtcatggttgccgttgctgtaacgtatctgcacagcacgcccgatctgcgtcagctcggtgcgtggttttacggcggctacaaactcgaaggcgaagcgtttaaagatgttgtcaaactgatttcgcgcggcggtttggaaagtatgtttttcacgcaaaccatcgtgattctcgggatgagtttgggcggactgttgtttgcgctcggtgtgattccttccctgttggaggccatccgtaccttcttgacgaatgccggacgcgcgacgttcagcgttgccatgacttcggtcggggttaatttcctgatcggcgagcaatatttgagtattttgttgtcgggtgaaacgttcaaacccgtttacgataagctcggtctgcattcgcgcaatctgtcgcggacgctggaagatgcggggacggtgattaacccgctcgtaccgtggagcgtatgcggcgtgttcatcagccacgcgctgggcgtgccggtttgggaatatctgccgtatgcctttttctgctatttgagtttggctttgaccctgttattcggttggacggggctgactttgagcaaaaaataa

SEQ ID NO: 2382 - protein, 459 aa, Neisseria meningitidis
MFAFKSLLDMPRGEALAVVVALIAAMGYTIISLEWLPHMSIIAAIVVLILYGLARGLKYNDMQQGMIGALNQGMGAIYLFFFIGLMVSALMMSGAIPTLMYYGFGLISPTYFYFSSFALCSVIGVSIGSSLTTCATVGVAFMGMAAAFQADMAMTAGAIVSGAFFGDKMSPLSDTTGISASIVGIDLFEHIKNMMYTTIPAWLISAALMLWLLPNVAAQDLNSVESFRSQLEATGLVHGYSLIPFALLVILALMRINAVVAMLFTVMVAVAVTYLHSTPDLRQLGAWFYGGYKLEGEAFKDVVKLISRGGLESMFFTQTIVILGMSLGGLLFALGVIPSLLEAIRTFLTNAGRATFSVAMTSVGVNFLIGEQYLSILLSGETFKPVYDKLGLHSRNLSRTLEDAGTVINPLVPWSVCGVFISHALGVPVWEYLPYAFFCYLSLALTLLFGWTGLTLSKK

SEQ ID NO: 2383 - DNA, 1380 bp, Neisseria meningitidis
  misc_feature (13)..(13): n is a, c, g, or t
  misc_feature (45)..(45): n is a, c, g, or t
  misc_feature (95)..(96): n is a, c, g, or t
  misc_feature (138)..(138): n is a, c, g, or t
  misc_feature (237)..(237): n is a, c, g, or t
  misc_feature (423)..(423): n is a, c, g, or t
  misc_feature (432)..(434): n is a, c, g, or t
  misc_feature (436)..(436): n is a, c, g, or t
  misc_feature (446)..(446): n is a, c, g, or t
  misc_feature (451)..(451): n is a, c, g, or t
  misc_feature (453)..(453): n is a, c, g, or t
  misc_feature (458)..(458): n is a, c, g, or t
  misc_feature (460)..(461): n is a, c, g, or t
  misc_feature (463)..(464): n is a, c, g, or t
  misc_feature (466)..(467): n is a, c, g, or t
  misc_feature (470)..(470): n is a, c, g, or t
  misc_feature (472)..(473): n is a, c, g, or t
  misc_feature (480)..(482): n is a, c, g, or t
  misc_feature (485)..(485): n is a, c, g, or t
  misc_feature (492)..(492): n is a, c, g, or t
  misc_feature (495)..(495): n is a, c, g, or t
  misc_feature (500)..(500): n is a, c, g, or t
  misc_feature (510)..(510): n is a, c, g, or t
  misc_feature (526)..(526): n is a, c, g, or t
  misc_feature (534)..(534): n is a, c, g, or t
  misc_feature (591)..(591): n is a, c, g, or t
  misc_feature (617)..(619): n is a, c, g, or t
  misc_feature (632)..(632): n is a, c, g, or t
  misc_feature (896)..(896): n is a, c, g, or t
  misc_feature (899)..(899): n is a, c, g, or t
  misc_feature (1060)..(1060): n is a, c, g, or t
  misc_feature (1137)..(1137): n is a, c, g, or t
  misc_feature (1265)..(1265): n is a, c, g, or t
atgttcgctttcnaatccttactcgatatgccgcgcggtgaggcncttgccgtcgtcgtcgctctgattgccgcgatgggctataccatcatttnnttggagtggctgccgcatatgtccattattgccgccatcgtngtgctgattttgtacggcttggcgcgcggtttgaaatacaacgatatgcagcagggcatgataggcgcgttgaatcagggtatgggcgcgatttacctntttttcttcatcgggctgatggtcagcgcgctgatgatgagcggcgcgattccgacgctgatgtattacggtttcggactgatttccccgacttatttttatttttccgccttcgcgctgtgttccgtcatcggcgtgtccatcggcagcagcctgaccacctgcgccactgtcggcgttgccttnatgggtatnnngncggcgtttcnggccnanatggngnngnngnnggncnngattgtnnnggncgcattnttnggcgncaaaatgtcnccgctttccgatacgncgggcatntccgcgtccattgtcggtatcgacctgtttgaacacatcaaaaatatgatgtacacnaccattcccgcgtggctcatcagtgnnncactgatgctgtngcttcttcccagcgtcgccgcgcaggatttgaacagcgtcgaatccttccgcagccagcttgaagccacgggattggtgcactgctattcgctgattccgtttgcgctgttggtcgttttggcattgatgcgcgtcaatgccgtggtcgctatgctctttaccgtcattgccgccgttgccgtaacgtatctgcacagcacgcccgatctgcgtcagctcggcgcgtggttttacggcggctacaaactcgaaggcgaagcgtntanagacattgccaaactcatttctcgcggcggtttggaaagtatgtttttcacgcagaccatcgtgattcttgggatgagccttggcgggctgctgtttgcactgggcgcgattccttccctgctggatgccgtccgcagctttttgacgaatgccgggcgtnccacattcagcgttgccatgacttcggtcggggttaatttcctgatcggcgagcaatatttgagtattttgttgtcnggtgaaacgttcaaacctgtttacgataagctcggtctgcattcgcgcaatctgtcgcggacgctggaagatgcggggacggtcatcaacccgctcgtaccgtggagcgtatgcggcgtgttcatcanccacgcgctgggcgtgccggtttgggaatatctgccgtatgcctttttctgctatttgagtttggctttgaccctgttattcggttggacggggctgactttgagcaaaaaataa

SEQ ID NO: 2384 - protein, 459 aa, Neisseria meningitidis
  misc_feature (5)..(5): Xaa can be any naturally occurring amino acid
  misc_feature (32)..(32): Xaa can be any naturally occurring amino acid
  misc_feature (141)..(141): Xaa can be any naturally occurring amino acid
  misc_feature (144)..(146): Xaa can be any naturally occurring amino acid
  misc_feature (149)..(149): Xaa can be any naturally occurring amino acid
  misc_feature (151)..(151): Xaa can be any naturally occurring amino acid
  misc_feature (153)..(158): Xaa can be any naturally occurring amino acid
  misc_feature (161)..(162): Xaa can be any naturally occurring amino acid
  misc_feature (164)..(165): Xaa can be any naturally occurring amino acid
  misc_feature (167)..(167): Xaa can be any naturally occurring amino acid
  misc_feature (176)..(176): Xaa can be any naturally occurring amino acid
  misc_feature (178)..(178): Xaa can be any naturally occurring amino acid
  misc_feature (206)..(207): Xaa can be any naturally occurring amino acid
  misc_feature (211)..(211): Xaa can be any naturally occurring amino acid
  misc_feature (299)..(300): Xaa can be any naturally occurring amino acid
  misc_feature (354)..(354): Xaa can be any naturally occurring amino acid
  misc_feature (422)..(422): Xaa can be any naturally occurring amino acid
MFAFXSLLDMPRGEALAVVVALIAAMGYTIIXLEWLPHMSIIAAIVVLILYGLARGLKYNDMQQGMIGALNQGMGAIYLFFFIGLMVSALMMSGAIPTLMYYGFGLISPTYFYFSAFALCSVIGVSIGSSLTTCATVGVAXMGXXXAFXAXMXXXXXXIVXXAXXGXKMSPLSDTXGXSASIVGIDLFEHIKNMMYTTIPAWLISXXLMLXLLPSVAAQDLNSVESFRSQLEATGLVHCYSLIPFALLVVLALMRVNAVVAMLFTVIAAVAVTYLHSTPDLRQLGAWFYGGYKLEGEAXXDIAKLISRGGLESMFFTQTIVILGMSLGGLLFALGAIPSLLDAVRSFLTNAGRXTFSVAMTSVGVNFLIGEQYLSILLSGETFKPVYDKLGLHSRNLSRTLEDAGTVINPLVPWSVCGVFIXHALGVPVWEYLPYAFFCYLSLALTLLFGWTGLTLSKK

SEQ ID NO: 2385 - DNA, 378 bp, Neisseria meningitidis
atggaaacccacgaaaaaatccgcctgatgcgcgaattgaataaatggtcccaggaggatatggcggaaaagctggcgatgtcggcaggcgggtatgccaaaatcgaacggggcgaaacgcagttaaatatcccgcgtttggagcagttggctcagattttcaaaatcgatatgtgggacttgctcaaatcgggcggtggtgggatggtgtttcagattaatgaaggtgatagtggtggcgatattgcgttgtatgcgtcgggtgatgtttcgatgaaaatagaatttttaaaaatggagttgaaacactgcaaagaaatgttggaacaaaaagacaaagaaatcgagctgctccgcaagctgaccgaaaccgtttaa

SEQ ID NO: 2386 - protein, 125 aa, Neisseria meningitidis
METHEKIRLMRELNKWSQEDMAEKLAMSAGGYAKIERGETQLNIPRLEQLAQIFKIDMWDLLKSGGGGMVFQINEGDSGGDIALYASGDVSMKIEFLKMELKHCKEMLEQKDKEIELLRKLTETV

SEQ ID NO: 2387 - DNA, 381 bp, Neisseria meningitidis
  misc_feature (276)..(276): n is a, c, g, or t
atggaaacccacgaaaaaatccgcctgatgcgcgaattgaataaatggtcccaggaggatatggcggaaaagctggcgatgtcggcaggcgggtatgccaaaatcgaacgaggcgaaacgcagttgaatatcccgcgtttggagcagttggcgcagattttcaaaattgatatgtgggacttgctcaaatcgggcggcggcgggatggtgttgcagattaacgatgtggataccaacagcggggaatttgcaatctataccgctcaggatgcatcnggtaaagctggatttgttaaaatggaattaaaacactgtaaagaaatgttggaacacaaagacaaagaaatcgagctgctccgcaagctgaccgaaaccgtttaa

SEQ ID NO: 2388 - protein, 126 aa, Neisseria meningitidis
METHEKIRLMRELNKWSQEDMAEKLAMSAGGYAKIERGETQLNIPRLEQLAQIFKIDMWDLLKSGGGGMVLQINDVDTNSGEFAIYTAQDASGKAGFVKMELKHCKEMLEHKDKEIELLRKLTETV

SEQ ID NO: 2389 - DNA, 1296 bp, Neisseria meningitidis
atgcccgcgcctgatttgggatttgccttaagtctgccgccaaaaaaggcaatcgagtggctggaaagtaaaaaggttacggcggagagctaccgcaatctgacagcctccgaaattgccaaagtctatacgattgcccgcatgaccgacttggatatgctcaacgacatcaaaacttcgatggttgaatcggcaaaaagtggacagtcgtttgacgattggcgaaaaggtatcttgaatctgctcagcaacaagggctggctgcatccgaacgggcataacggtaaggatatcatcgacccagccaccggcgaggtattcggttcgccgcggaggttggagacgatttaccgtaccaatatgcaaactgcctacaacgccggtcaatatcaaggatatatggcaaatattgatgcacgaccttattggatgtatgacgcggtaggcgacagccgcacccgtccggcgcattcggcaatagacgggctggtgtaccgctacgacgacccgttttgggcaacgttttacccgcccaacggctacaactgccgctgctcggtcatcgcgctgtcggagcgggatgtggaacgccaggggcggattgttgggcaaagcacggcggacaatctggtcgagacccataaaatctacaacaaaaaaggcgatacttatctgacccttgcctataaagcaccggatggcagtctgtacacgaccgatcgaggatttgattacaacgccggacgaatgaactaccgccccgatttagacaagtacgaccgtgcgttggcgcatcaatttgccaaagcggaaatgggtggtgcggattttaaaaccagctttaaacagcttgaaaaagagttttatgaagtcaagcaacgtttggatattgatggcaagcccgataaagagcagaaaatcaaaatccgaaatgcgctatcaagacagcttaaatttgctgcgggtgtattgagcaaggaaacgcaagaattggcaggtatgacacgagcgacggtgtggctgtctgatgatacgttggttaaacaggtagacagccgtgaggggcagaatttcgatgactcctactatgcttttttgccggatatgctgcaaaaccctgaacatgtcatccgcgacaatcgtgaattgattttcacagctcgctataaaggctcggcattgtgggcagttttaaaatatattaaggaggtggatgagatttatctacagtcgtaccgaatcagtaacgacaaagagattgccaaatttatggcgaagaagaaagtattgaaatag

SEQ ID NO: 2390 - protein, 431 aa, Neisseria meningitidis
MPAPDLGFALSLPPKKAIEWLESKKVTAESYRNLTASEIAKVYTIARMTDLDMLNDIKTSMVESAKSGQSFDDWRKGILNLLSNKGWLHPNGHNGKDIIDPATGEVFGSPRRLETIYRTNMQTAYNAGQYQGYMANIDARPYWMYDAVGDSRTRPAHSAIDGLVYRYDDPFWATFYPPNGYNCRCSVIALSERDVERQGRIVGQSTADNLVETHKIYNKKGDTYLTLAYKAPDGSLYTTDRGFDYNAGRMNYRPDLDKYDRALAHQFAKAEMGGADFKTSFKQLEKEFYEVKQRLDIDGKPDKEQKIKIRNALSRQLKFAAGVLSKETQELAGMTRATVWLSDDTLVKQVDSREGQNFDDSYYAFLPDMLQNPEHVIRDNRELIFTARYKGSALWAVLKYIKEVDEIYLQSYRISNDKEIAKFMAKKKVLK

SEQ ID NO: 2391 - DNA, 1296 bp, Neisseria meningitidis
atgcccgcgcctgatttgggatttgccttaagtctgccgccaaaaaaggcaatcgagtggctggaaagtaaaaaggttacggcggagagctaccgcaatctgacagcctccgaaattgccaaagtctatacgattgcccgcatgaccgacttggatatgctcaacgacatcaaaacttcgatggttgaatcggcaaaaagtggacagtcgtttgacgattggcgaaaaggtatcttgaatctgctcagcaacaagggctggctgcatccgaacgggcataacggtaaggatatcatcgacccagccaccggcgaggtattcggttcgccgcggaggttggagacgatttaccgtaccaacatgcaaactgcctacaacgccggtcaatatcaaggatatatggcaaatattgatgcacgaccttattggatgtatgacgcggtaggcgacagccgcacccgtccggcgcattcggcaatagacgggctggtgtaccgctacgacgacccgttttgggcaacgttttacccgcccaacggctacaactgccgttgctcggtcatcgcgctgtcggagcgggatgtggaacgccaggggcggattgtcgggcaaagcacgtcggacaatcttgttgagacccataaaatctacaacaaaaaaggcgatacttatctgacccttgcctataaagcaccggatggcagtctgtacacgaccgatcgaggatttgattacaacgccggacgaatgaactaccgccccgatttagacaagtacgaccgtgcgttggcgcatcaatttgccaaagcggaaatgggtggtgcggattttaaaaccagctttaaacagcttgaaaaagagttttatgaagtcaagcaacgtttggatattgatggcaagcccgataaagagcagaaaatcaaaatccgaaatgcgctatcaagacagcttaaatttgctgcgggtgtattgagcaaggaaacgcaagaattggcaggtatgacacgagcgacggtgtggctgtctgatgatacgttggttaaacaggtagacagccgtgaagggcagaatttcgatgactcctactatgcttttttgccggatatgctgcaaaaccctgaacatgtcatccgcgacaatcgtgaattgattttcacagctcgctataaaggctcggcattgtgggcagttttaaaatatattaaggaggtggatgagatttatctacagtcgtaccgaatcagtaacgacaaagagattgccaaatttatggcgaagaagaaagtattgaaatag

SEQ ID NO: 2392 - protein, 431 aa, Neisseria meningitidis
MPAPDLGFALSLPPKKAIEWLESKKVTAESYRNLTASEIAKVYTIARMTDLDMLNDIKTSMVESAKSGQSFDDWRKGILNLLSNKGWLHPNGHNGKDIIDPATGEVFGSPRRLETIYRTNMQTAYNAGQYQGYMANIDARPYWMYDAVGDSRTRPAHSAIDGLVYRYDDPFWATFYPPNGYNCRCSVIALSERDVERQGRIVGQSTSDNLVETHKIYNKKGDTYLTLAYKAPDGSLYTTDRGFDYNAGRMNYRPDLDKYDRALAHQFAKAEMGGADFKTSFKQLEKEFYEVKQRLDIDGKPDKEQKIKIRNALSRQLKFAAGVLSKETQELAGMTRATVWLSDDTLVKQVDSREGQNFDDSYYAFLPDMLQNPEHVIRDNRELIFTARYKGSALWAVLKYIKEVDEIYLQSYRISNDKEIAKFMAKKKVLK

SEQ ID NO: 2393 - DNA, 1413 bp, Neisseria meningitidis
atgatgccccatattgattttgacacgattccgggcagcatccgcgtgcccgggcagtatattgaatttaacacccgcaatgccgtacaaggtttgccgcaaaatccgcaaaaggtattgatggttgcacccatgctgaccgcgggcatacagcccgccttagagccggtgcaactatttagcgatgccgaggcggccgatttgttcggacaaggctcgctggcgcatttgatggtgcgccaagcatttgccaacaacccttatttggatttgaccgttatcggtattgccgaccacagcgcaggcgtgcaggcaaccgcaaccgttaccctttccggcacggccaccgcgccgggcgtggtggaaatcacgattggcggcaagcaggtaagcacggccgttaacaccggcgagaccgccgccacagtggcagaccgtctgaaaaccgccatcactgccgccgatgtaaccgttaccgcatccggcagcggcgcagccgttacgctgacggccaaacacaaaggcgagatcggcaacgagagcggcttaaccgtgagcaccggcaataccggcctaacttatcaagccaatgcctttaccggcggtgccaaaaatgcggacattgccacggccttgtccaaagtggcgggcaagcattatcacattatttgcagcccgtttagcgatgacgccaacgccaaagccttgagcaaccatattaccaacgtatccaacgccatcgagcagcgcggctgtatcggcgtattgggtatgagtgcggccttgagcacggccaccaccgctaccggcgaaatcaacgacggccgcatgacctgtgcttggtacaaaggtgcggtagagccaaacggcatcatcgccgcaggttatgcggcggtgttggcctttgaagaagaccctgccaagccgctgaacacgctggaaatcaaagggctggccgttacacctgatgcgcaatggccgctgtttgcagaatgcaacaatgcgctgtacaacggcttgaccccgctcacagtggtcaacaaccgcgtgcagattatgcgtgccgtatccacctataccaagtcggccaacaacaccgacgacccggcactactcgacattaccaccatccgcacgctggattatgtgcgccgcagcgttaaagagcgcattgccctgcgttttccgcgcgacaaattgagcgaccgcctgctgcccaaggttaagagcgagattttggacgtgctgattaagctcgaccaagccgaaatcatcgaaaacgccgaggccaacaaaggcaagctggtggtggcgcgtgcgcaaaacgaccccaaccgtgttaatgccattatccccgccgatgtggtcaacggcctgcacgtctttgccgggcgcattgatttgattttgtaa

SEQ ID NO: 2394 - protein, 470 aa, Neisseria meningitidis
MMPHIDFDTIPGSIRVPGQYIEFNTRNAVQGLPQNPQKVLMVAPMLTAGIQPALEPVQLFSDAEAADLFGQGSLAHLMVRQAFANNPYLDLTVIGIADHSAGVQATATVTLSGTATAPGVVEITIGGKQVSTAVNTGETAATVADRLKTAITAADVTVTASGSGAAVTLTAKHKGEIGNESGLTVSTGNTGLTYQANAFTGGAKNADIATALSKVAGKHYHIICSPFSDDANAKALSNHITNVSNAIEQRGCIGVLGMSAALSTATTATGEINDGRMTCAWYKGAVEPNGIIAAGYAAVLAFEEDPAKPLNTLEIKGLAVTPDAQWPLFAECNNALYNGLTPLTVVNNRVQIMRAVSTYTKSANNTDDPALLDITTIRTLDYVRRSVKERIALRFPRDKLSDRLLPKVKSEILDVLIKLDQAEIIENAEANKGKLVVARAQNDPNRVNAIIPADVVNGLHVFAGRIDLIL

SEQ ID NO: 2395 - DNA, 1146 bp, Neisseria meningitidis
atgcaaaataattcatacggctatgccgtgtcggtgcgcgtgggcggtaaagagcaccgccactgggagcgctacgacatcgacagcgactttttaatccctgccgacagcttcgattttgtcatcggcaggttgggaccggaggcggccatacccgatttaagcggagagagctgcgaggtagtgatagacgggcaaatcgtgatgacgggcatcatcggcagccagcgccacggcaaaagcaagggcagccgcgagttgagcttgagcgggcgtgatttggccggttttttggtggattgctccgcgccgcagctcaatgtaaagggcatgacggtattggatgcagccaaaaagctggccgcgccgtggccgcagattaaagcggtggtgcttaaggccgaaaacaaccccgctttgggcaaaatcgacatcgagccgggcgaaaccgtatggcaggcattaacccatattgccaactcggtcgggctgcatccgtggctggagccggacggcacgttggtggtgggcggtgcggattacagcagcccgccggtggcgacattgtgttggagccgcaccgacagccgctgcaatatcgagcgcatggacattgagtgggataccgacaaccgcttttccgaggttacttttttggcgcaatcgcacggccgcagcggcgacagcgccaaacacgatttaaagtgggtgtacaaagacccgacgatgacgctgcaccgccctaaaacggtggtggtgtccgatgccgacaatttggccgcattgcaaaagcaggctaaaaagcagctggccgactggcggctggagggatttacactcacgataaccgtgggcggccataaaacccgcgacggcgtattgtggcaacctggcctgcgtgtgcatgtgatcgacgacgagcacggtatcgatgcggtgttttttctgatggggcggcggtttatgctatcccgcatggatggtacgcaaaccgagctgcggctcaaagaggacggtatttggacacccgacgcttaccccaaaaaggccgaggcggcgcgcaagcgcaaaggcaaacgcaaaggcgtgagccataagggcaaaaaaggcggcaaaaaacaagcagaaacggcggtgtttgaatga

SEQ ID NO: 2396 - protein, 381 aa, Neisseria meningitidis
MQNNSYGYAVSVRVGGKEHRHWERYDIDSDFLIPADSFDFVIGRLGPEAAIPDLSGESCEVVIDGQIVMTGIIGSQRHGKSKGSRELSLSGRDLAGFLVDCSAPQLNVKGMTVLDAAKKLAAPWPQIKAVVLKAENNPALGKIDIEPGETVWQALTHIANSVGLHPWLEPDGTLVVGGADYSSPPVATLCWSRTDSRCNIERMDIEWDTDNRFSEVTFLAQSHGRSGDSAKHDLKWVYKDPTMTLHRPKTVVVSDADNLAALQKQAKKQLADWRLEGFTLTITVGGHKTRDGVLWQPGLRVHVIDDEHGIDAVFFLMGRRFMLSRMDGTQTELRLKEDGIWTPDAYPKKAEAARKRKGKRKGVSHKGKKGGKKQAETAVFE

SEQ ID NO: 2397 - DNA, 1146 bp, Neisseria meningitidis
atgcaaaataattcatacggctatgccgtgtcggtgcgcgtgggcggtaaagagcaccgccactgggagcgctacgacatcgacagcgactttttaatccctgccgacagcttcgattttgtcatcggcaggttggggccggaggcggccatacccgatttaagcggagagagctgcgaggtagtgatagacgggcaaatcgtgatgacgggcatcatcggcagccagcgccacggcaaaagcaagggcggccgcgagttgagcttgagcgggcgtgatttggccggttttttggtggattgctccgcgccgcagctcaatgtaaagggcatgacggtattggatgcagccaaaaagctggccgcgccgtggccgcagattaaagcggtggtgcttaaggtcgaaaacaaccccgctttggacaaaatcgacatcgagccgggcgaaaccgtatggcaggcattaacccatattgccaactcggtcgggctgcatccgtggctggagccggacggcacgttggtggtgggcggtgtggattacagcagcccgccggtggcgacattgtgttggagccgcaccgacagccgccgcaatatcgagcgcatggacattgagtgggataccgacaaccgcttttctgaggttacttttttggcgcaatcgcacggccgcagcggcgacagcgccaaacacgatttaaagtgggtgtacaaagacccgacgatgacgctgcaccgccctaaaacggtggtggtgtccgatgccgacaatttggccgcattgcaaaagcaggctaaaaagcagctggccgactggcggctggagggatttacactcacgataaccgtgggcggccataaaacccgcgacggcgtattgtggcaacctggccagcgtgtgcatgtgatcgacgacgagcacggtatcgatgcggtgttttttctgatggggcggcggtttatgctatctcgcatggatggcacgcaaaccgagctgcggctcaaagaggacggtatttggacacccgacgcttaccccaaaaaggccgaggcggcgcgcaagcgcaaaggcaaacgcaaaggcgtgagccataagggcaaaaaaggcggcaaaaaacaagcagaaacggcggtgtttgaatga

SEQ ID NO: 2398 - protein, 381 aa, Neisseria meningitidis
MQNNSYGYAVSVRVGGKEHRHWERYDIDSDFLIPADSFDFVIGRLGPEAAIPDLSGESCEVVIDGQIVMTGIIGSQRHGKSKGGRELSLSGRDLAGFLVDCSAPQLNVKGMTVLDAAKKLAAPWPQIKAVVLKVENNPALDKIDIEPGETVWQALTHIANSVGLHPWLEPDGTLVVGGVDYSSPPVATLCWSRTDSRRNIERMDIEWDTDNRFSEVTFLAQSHGRSGDSAKHDLKWVYKDPTMTLHRPKTVVVSDADNLAALQKQAKKQLADWRLEGFTLTITVGGHKTRDGVLWQPGQRVHVIDDEHGIDAVFFLMGRRFMLSRMDGTQTELRLKEDGIWTPDAYPKKAEAARKRKGKRKGVSHKGKKGGKKQAETAVFE

SEQ ID NO: 2399 - DNA, 561 bp, Neisseria meningitidis
atgagctatcaagacatcttgcggggcctgttgccccccgtgtcgtatgcccgcaatgccccgcgtgtgcgggcgcaggcagaaatagacggcgcagcgctggatgcggtggcggaatcggctcaaagcgttgccgatgccgtcgacccgcgcagcgccggccaaatgctggccgattgggagcgcgtattaggtttggacggtacgggcaaaaaccgccagcaccgtgtgttggccgtcatggccaagctaaacgaaacaggcggcttgagtattccttattttgtgcgtttggccgaggcggcgggctatcaaatccaaatcgacgaaccgcagccgttccgcgccggtgtaaaccgcgccggcgaccgtcttgcgccgcaggaaatcatgtgggtgtggcacgttaacgtgcgcggcggcaacaaccgcattacccgattccgcgccggtatctcggcggcgggcgacaggctgaccgattacagcgatgccgtgatcgagagcctgttcaaccgcctcaagcccgcccacaccgctatccgatttacctaccgctaa

SEQ ID NO: 2400 - protein, 186 aa, Neisseria meningitidis
MSYQDILRGLLPPVSYARNAPRVRAQAEIDGAALDAVAESAQSVADAVDPRSAGQMLADWERVLGLDGTGKNRQHRVLAVMAKLNETGGLSIPYFVRLAEAAGYQIQIDEPQPFRAGVNRAGDRLAPQEIMWVWHVNVRGGNNRITRFRAGISAAGDRLTDYSDAVIESLFNRLKPAHTAIRFTYR

SEQ ID NO: 2401 - DNA, 561 bp, Neisseria meningitidis
atgagctatcaagacatcttgcggggtctgttgccccccgtgtcgtatgcccgcaatgccccgcgtgtgcgggcgcaggcagaaatagacggcgcagcgctggatgcggtggcggaatcggctcaaagcgttgccgatgccgtcgacccgagcagcgccggccaaatgctggccgattgggagcgcgtattaggtttggacggtacgggcaaaaaccgccagcgccgtgtgttggccgtcatggccaagctaaacgaaacaggcggcttgagtattccttattttgtgcgtttggccgaggcggcgggctatcaaatccaaatcgacgaaccgcagccgttccgcgccggtgtaaaccgcgccggcgaccgtcttgcgccgcaggaaatcatgtgggtgtggcacgttaacgtgcgcggcggcaacaaccgcattacccgattccgcgccggtatctcggcggcgggcgacaggctgaccgattacagcgatgccgtgatcgagagcctgttcaaccgcctcaagcccgcccacaccgctatccgatttacctaccgataa

SEQ ID NO: 2402 - protein, 186 aa, Neisseria meningitidis
MSYQDILRGLLPPVSYARNAPRVRAQAEIDGAALDAVAESAQSVADAVDPSSAGQMLADWERVLGLDGTGKNRQRRVLAVMAKLNETGGLSIPYFVRLAEAAGYQIQIDEPQPFRAGVNRAGDRLAPQEIMWVWHVNVRGGNNRITRFRAGISAAGDRLTDYSDAVIESLFNRLKPAHTAIRFTYR

SEQ ID NO: 2403 - DNA, 417 bp, Neisseria meningitidis
atgattgatgtcaaaatagacaatatctttgtcgtcctaaaccaaatcgagcggcttggcaacgggatcgaaaaccgctacctgctgatgcgccgactgtccgaaaccatgcacacggcggtcaagctcaatttccgctacgcaggccgtccgaaatgggttgggctaaaataccgcgacggcaagccgctttcggattcgggtcgtctgaaagacagtttttccacactgtcagacaacgatacagcccttgtcggtacgaatatcgtctatgccgccatccacaacttcggcggtatggcggggcgcaaccgcaaagttcggattccgcaacgggaatttttgacgctgacggacgacgacaaacaggctttgatggacgatgtgcaggattatttttcgggtctgataccgtga

SEQ ID NO: 2404 - protein, 138 aa, Neisseria meningitidis
MIDVKIDNIFVVLNQIERLGNGIENRYLLMRRLSETMHTAVKLNFRYAGRPKWVGLKYRDGKPLSDSGRLKDSFSTLSDNDTALVGTNIVYAAIHNFGGMAGRNRKVRIPQREFLTLTDDDKQALMDDVQDYFSGLIP

SEQ ID NO: 2405 - DNA, 417 bp, Neisseria meningitidis
atgattgatgtcaaaatagacaatatctttgtcgtcctaaaccaaatcgagcggcttggcaacgggatcgaaaaccgctacctgctgatgcgccgactgtccgaaaccatgcacacggcggtcaagctcaatttccgctacgcaggccgtccgaaatggttggggctaaaataccgcgacggcaagccgctttcggattcgggtcgtctgaaagacagtttttccacactgtcagacaacgatacagcccttgtcggtacgaatatcgtctatgccgccatccacaacttcggcggtatggcggggcgcaaccgcaaagttcggattccgcaacgggaatttttgacgctgacggacgacgacaaacaggctttgatggacgatgtgcaggattatttttcgggtctgataccgtga

SEQ ID NO: 2406 - protein, 138 aa, Neisseria meningitidis
MIDVKIDNIFVVLNQIERLGNGIENRYLLMRRLSETMHTAVKLNFRYAGRPKWLGLKYRDGKPLSDSGRLKDSFSTLSDNDTALVGTNIVYAAIHNFGGMAGRNRKVRIPQREFLTLTDDDKQALMDDVQDYFSGLIP

SEQ ID NO: 2407 - DNA, 339 bp, Neisseria gonorrhoeae
atgaacaaaaatattgctgccgcactcgccggtgctttatccctgtctctggccgccggcgccgttgccgcccacaaaccggcaagcaacgcaacaggcgttcaaaaatccgcccaaggctcttgcggcgcatccaaatctgccgaaggttcgtgcggcgcatccaaatctgccgaaggttcgtgcggcgcggctgcttctaaagcaggcgaaggcaaatgcggcgagggcaaatgcggtgcaactgtaaaaaaagcccacaaacacaccaaagcatctaaagccaaagccaaatctgccgaaggcaaatgcggcgaaggcaaatgcggttctaaataa

SEQ ID NO: 2408 - protein, 112 aa, Neisseria gonorrhoeae
MNKNIAAALAGALSLSLAAGAVAAHKPASNATGVQKSAQGSCGASKSAEGSCGASKSAEGSCGAAASKAGEGKCGEGKCGATVKKAHKHTKASKAKAKSAEGKCGEGKCGSK

SEQ ID NO: 2409 - DNA, 309 bp, Neisseria meningitidis
atgaacaaaaacattgctgccgctctcgccggtgctttatccctgtctttggccgccggtgcagttgctgccaacaaaccggcaagcaacgcaacaggcgttcataaatccgcccatggctcttgcggcgcgtccaaatctgccgaaggttcgtgcggcgcggctggttctaaagcaggcgaaggcaaatgcggcgagggcaaatgcggtgcgaccgtaaaaaaaacccacaaacacaccaaagcatctaaagccaaggccaaatctgccgaaggcaaatgcggcgaaggcaaatgcggttctaaataa

SEQ ID NO: 2410 - protein, 102 aa, Neisseria meningitidis
MNKNIAAALAGALSLSLAAGAVAANKPASNATGVHKSAHGSCGASKSAEGSCGAAGSKAGEGKCGEGKCGATVKKTHKHTKASKAKAKSAEGKCGEGKCGSK

SEQ ID NO: 2411 - DNA, 309 bp, Neisseria meningitidis
atgaacaaaaacattgctgccgcactcgccggtgctttatccctgtctttggccgccggtgcagttgctgccaacaaaccggcaagcaacgcaacaggcgttcataaatccgcccatggctcttgcggcgcgtccaaatctgccgaaggttcgtgcggcgcggctggttctaaagcaggcgaaggcaaatgcggcgagggcaaatgcggtgcgaccgtaaaaaaaacccacaaacacaccaaagcatctaaagccaaggccaaatctgccgaaggcaaatgcggcgaaggcaaatgcggttctaaataa

SEQ ID NO: 2412 - protein, 102 aa, Neisseria meningitidis; identical to SEQ ID NO: 2410

SEQ ID NO: 2413 - DNA, 1422 bp, Neisseria gonorrhoeae
atggacacaaaagaaatcctcggctacgcggcaggctcgatcggcagcgcggttttagccgtcatcatcctgccgctgctgtcgtggtatttccccgccgacgacatcgggcgcatcgtgctgatgcagacggcggcgggactgacggtgtcggtattgtgcctcgggctggatcaggcatacgtccgcgaatactatgccgccgccgacaaagacactttgttcaaaaccctgttcctgccgccgctgctgttttccgccgcgatagccgccctgctgctttcccgcccgtccctgccgtctgaaatcctgttttcgctcgacgatgccgccgccggcatcgggctggtgctgtttgaactgagcttcctgcccatccgctttctcttactggttttgcgtatggaagggcgcgcccttgccttttcgtccgcgcaactcgtgcccaaactcgccattctgctgctgttgccgctgacggtcgggctgctgcactttccggcgaacacctccgtcctgaccgccgtttacgcgctggcaaaccttgccgccgccgcctttttgctgtttcaaaaccgatgccgtctgaaggccgtccggcgcgcgccgttttcgcccgccgtcctgcaccgggggctgcgctacggcataccgctcgcactgagcagccttgcctattgggggctggcatccgccgaccgtttgttcctgaaaaaatatgcgggcctggaacagctcggcgtttattcgatgggtatttcgttcggcggggcggcattattgctccaaagcatcttttcaacggtctggacaccgtatattttccgtgcaatcgaagaaaacgccacgcccgcccgcctctcggcaacggcagaatccgccgccgccctgcttgcctccgccctctgcctgaccggaattttctcgcccctcgcctccctcctgctgccggaaaactacgccgccgtccggtttaccgtcgtatcgtgtatgctgccgccgctgttttacacgctgaccgaaatcagcggcatcggtttgaacgtcgtccgcaaaacgcgtccgatcgcgcttgccaccttgggcgcgctggcggcaaacctgctgctgctggggcttgccgtaccgtccggcggcacgcgcggcgcggcggttgcctgtgccgcctcattctggttgttttttgttttcaagacagaaagctcctgccgcctgtggcagccgctcaaacgcctgccgctttatatgcacacattgttctgcctggcctcctcggcggcctacacctgcttcggcacaccggcaaactaccccctgtttgccggcgtatgggcggcatatctggcaggctgcatcctgcgccaccggaaaaatttgcacaaactgtttcattatttgaaaaaacaaggtttcccattatga

SEQ ID NO: 2414 - protein, 473 aa, Neisseria gonorrhoeae
MDTKEILGYAAGSIGSAVLAVIILPLLSWYFPADDIGRIVLMQTAAGLTVSVLCLGLDQAYVREYYAAADKDTLFKTLFLPPLLFSAAIAALLLSRPSLPSEILFSLDDAAAGIGLVLFELSFLPIRFLLLVLRMEGRALAFSSAQLVPKLAILLLLPLTVGLLHFPANTSVLTAVYALANLAAAAFLLFQNRCRLKAVRRAPFSPAVLHRGLRYGIPLALSSLAYWGLASADRLFLKKYAGLEQLGVYSMGISFGGAALLLQSIFSTVWTPYIFRAIEENATPARLSATAESAAALLASALCLTGIFSPLASLLLPENYAAVRFTVVSCMLPPLFYTLTEISGIGLNVVRKTRPIALATLGALAANLLLLGLAVPSGGTRGAAVACAASFWLFFVFKTESSCRLWQPLKRLPLYMHTLFCLASSAAYTCFGTPANYPLFAGVWAAYLAGCILRHRKNLHKLFHYLKKQGFPL

SEQ ID NO: 2415 - DNA, 1422 bp, Neisseria meningitidis
atggacacaaaagaaatcctcggctacgcggcaggctcgatcggcagcgcggttttagccgtcatcatcctgccgctgctgtcgtggtatttccccgccgacgacatcgggcgcatcgtgctgatgcagacggcggcggggctgacggtgtcggtgttgtgcctcgggctggatcaggcatacgtccgcgaatactatgccaccgccgacaaagacaccttgttcaaaaccctgttcctgccgccgctgctgtctgccgccgcgatagccgccctgctgctttcccgcccgtccctgccgtctgaaatcctgttttcactcgacgatgccgccgccggcatcgggctggtgctgtttgaactgagcttcctgcccatccgctttctcttactggttttgcgtatggaaggacgcgcccttgccttttcgtccgcgcaactcgtgcccaagctcgccatcctgctgctgctgccgctgacggtcgggctgctgcactttccagcgaacaccgccgtcctgaccgccgtttacgcgctggcaaaccttgccgccgccgcctttttgctgtttcaaaaccgatgccgtctgaaggccgtccggcacgcaccgttttcgcccgccgtcctgcaccgggggctgcgctacggcataccgatcgcactgagcagcatcgcctattgggggctggcatccgccgaccgtttgttcctgaaaaaatatgccggcctggaacagctcggcgtttattcgatgggtatttcgttcggcggggcggcattattgttccaaagcatcttttcaacggtctggacaccgtatattttccgcgcaatcgaagaaaacgccccgcccgcccgcctctcggcaacggcagaatccgccgccgccctgcttgcctccgccctctgcctgaccggcattttctcgccccttgcctccctcctgctgccggaaaactacgccgccgtccggtttatcgtcgtatcgtgtatgctgccgccgctgttttgcacgctggcggaaatcagcggcatcggtttgaacgtcgtccgcaaaacgcgcccgatcgcgctcgccaccttgggcgcgctggcggcaaacctgctgctgctggggcttgccgtgccgtccggcggcgcgcgcggcgcggcggttgcctgtgccgcctcattctggctgttttttgccttcaagaccgaaagctcctgccgcctgtggcagccgctcaaacgcctgccgctttatctgcacacattgttctgcctgacctcctcggcggcctacacctgcttcggcacgccggcaaactatcccctgtttgccggcgtatgggcggcatatctggcaggctgcatcctgcgccaccggaaagatttgcacaaactgtttcattatttgaaaaaacaaggtttcccattatga

SEQ ID NO: 2416 - protein, 473 aa, Neisseria meningitidis
MDTKEILGYAAGSIGSAVLAVIILPLLSWYFPADDIGRIVLMQTAAGLTVSVLCLGLDQAYVREYYATADKDTLFKTLFLPPLLSAAAIAALLLSRPSLPSEILFSLDDAAAGIGLVLFELSFLPIRFLLLVLRMEGRALAFSSAQLVPKLAILLLLPLTVGLLHFPANTAVLTAVYALANLAAAAFLLFQNRCRLKAVRHAPFSPAVLHRGLRYGIPIALSSIAYWGLASADRLFLKKYAGLEQLGVYSMGISFGGAALLFQSIFSTVWTPYIFRAIEENAPPARLSATAESAAALLASALCLTGIFSPLASLLLPENYAAVRFIVVSCMLPPLFCTLAEISGIGLNVVRKTRPIALATLGALAANLLLLGLAVPSGGARGAAVACAASFWLFFAFKTESSCRLWQPLKRLPLYLHTLFCLTSSAAYTCFGTPANYPLFAGVWAAYLAGCILRHRKDLHKLFHYLKKQGFPL

SEQ ID NO: 2417 - DNA, 1422 bp, Neisseria meningitidis
atggacacaaaagaaatcctcggctacgcggcaggctcgatcggcagcgcggttttagccgtcatcatcctgccgctgctgtcgtggtatttccctgccgacgacatcggacgcatcgtgctgatgcagacggcggcggggctgacggtgtcggtgttgtgcctcgggctggatcaggcatacgtccgcgaatactatgccgccgccgacaaagacactttgttcaaaaccctgttcctgccgccgctgctgtctgccgccgcgatagccgccctgctgctttcccgcccatccctgccgtctgaaatcctgttttcgctcgacgatgccgccgccggcatcgggctggtgctgtttgaactgagcttcctgcccatccgctttctcttactggttttgcgtatggaaggacgcgcccttgccttttcgtccgcgcaactcgtgtccaagctcgccatcctgctgctgctgccgctgacggtcgggctgctgcactttccggcgaacaccgccgtcctgaccgccgtttacgcgctggcaaaccttgccgccgccgcctttttgctgtttcaaaaccgatgccgtctgaaggccgtccggcgcgcaccgttttcatccgccgtcctgcatcgcggcctgcgctacggcataccgatcgcactaagcagcatcgcctattgggggctggcatccgccgaccgtttgttcctgaaaaaatatgccggcctagaacagctcggcgtttattcgatgggtatttcgttcggcggagcggcattattgttccaaagcatcttttcaacggtctggacaccgtatattttccgcgcaatcgaagcaaacgccccgcccgcccgcctctcggcaacggcagaatccgccgccgccctgcttgcctccgccctctgcctgaccggcattttctcgcccctcgcctccctcctgctgccggaaaactacgccgccgtccggtttatcgtcgtatcgtgtatgctgcctccgctgttttgcacgctggtagaaatcagcggcatcggtttgaacgtcgtccgaaaaacacgcccgatcgcgctcgccaccttgggcgcgctggcggcaaacctgctgctgctggggcttgccgtaccgtccggcggcgcgcgcggcgcggcggttgcctgtgccgcctcattttggctgttttttgttttcaagaccgaaagctcctgccgcctgtggcagccgctcaaacgcctgccgctttatatgcacacattgttctgcctggcctcctcggcggcctacacctgcttcggcactccggcaaactaccccctgtttgccggcgtatgggcggtatatctggcaggctgcatcctgcgccaccggaaagatttgcacaaactgtttcattatttgaaaaaacaaggtttcccattatga

SEQ ID NO: 2418 - protein, 473 aa, Neisseria meningitidis
MDTKEILGYAAGSIGSAVLAVIILPLLSWYFPADDIGRIVLMQTAAGLTVSVLCLGLDQAYVREYYAAADKDTLFKTLFLPPLLSAAAIAALLLSRPSLPSEILFSLDDAAAGIGLVLFELSFLPIRFLLLVLRMEGRALAFSSAQLVSKLAILLLLPLTVGLLHFPANTAVLTAVYALANLAAAAFLLFQNRCRLKAVRRAPFSSAVLHRGLRYGIPIALSSIAYWGLASADRLFLKKYAGLEQLGVYSMGISFGGAALLFQSIFSTVWTPYIFRAIEANAPPARLSATAESAAALLASALCLTGIFSPLASLLLPENYAAVRFIVVSCMLPPLFCTLVEISGIGLNVVRKTRPIALATLGALAANLLLLGLAVPSGGARGAAVACAASFWLFFVFKTESSCRLWQPLKRLPLYMHTLFCLASSAAYTCFGTPANYPLFAGVWAVYLAGCILRHRKDLHKLFHYLKKQGFPL

SEQ ID NO: 2419 - DNA, 1143 bp, Neisseria meningitidis
tcagacggcctttacgtaccccgaaactttatccaccgcccgcaaagctggttcaaatgggacaaagacaacgggctgctgctgcgtacccgcgaaaatccggaaggcgaagcgttgtggccgctgggctgggtcgttcatacccaaaaatcgcgcagcgtccagcaggcgcgcaacgggcttttccgcacgctttcctggctgtatatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtcacaacgcggcaggcatcatgccagaaggtatggaaatagagctccacaacgcggcaaacggtacgacggcaaccagcaatccgtttttgcagatggccgactggtgcgaaaaatcggcggcgcggctgattttggggcaaacgctgaccagcggtgcggacggaaaatccagcaccaacgcgctgggcaatatccacaacgaggtacgccgcgatttgctggtgtcggacgcaaaacaggtggcgcaaaccatcacaagccaaatcatcggaccgttcctgcaaatcaactatccccatgccgacccaaaccgcgtgccgaaatttgaatttgacacgcgcgagccgaaagacatcgcggtctttgccgacgctatcccgaaactggtggatgtcggcgtacaaatccccgaaagctgggtgcgcgacaaactggtcattccagatgtgcaggagggtgaggctgtgttggtgcggcaggtaccggacaatccggtaaacagaactgcattggcggctttatccgcccacaccgtaccatctaaggctacgggcaggcatcaggaaatattggacggcgcgttggatgacgcgctggttgagcccgatttcaattctcagctcaacccgatggtgcgtcaggcggttgccgcacttaatgcttgcaacagctacgaggaggcagatgccgcactgaatgcgctttatccgaatttggacaacgcgaaactgcgtacctatatgcagcaggccttgtttatcagcgatattttgggacaagaccatgcccgcgcctga

SEQ ID NO: 2420 - protein, 380 aa, Neisseria meningitidis
SDGLYVPRNFIHRPQSWFKWDKDNGLLLRTRENPEGEALWPLGWVVHTQKSRSVQQARNGLFRTLSWLYMFKHYAVHDFAEFLELYGMPIRIGKYGAGATKEEKNTLLRAVAEIGHNAAGIMPEGMEIELHNAANGTTATSNPFLQMADWCEKSAARLILGQTLTSGADGKSSTNALGNIHNEVRRDLLVSDAKQVAQTITSQIIGPFLQINYPHADPNRVPKFEFDTREPKDIAVFADAIPKLVDVGVQIPESWVRDKLVIPDVQEGEAVLVRQVPDNPVNRTALAALSAHTVPSKATGRHQEILDGALDDALVEPDFNSQLNPMVRQAVAALNACNSYEEADAALNALYPNLDNAKLRTYMQQALFISDILGQDHARA

SEQ ID NO: 2421 - DNA, 1581 bp, Neisseria meningitidis
atggagccgataatggcaaaaaagaacaataaaactaaaatccaaaagcccgaagctgcattgcagacggacgtggctcaaattacagcgaccggtcgagttatcgccgagcatccatccaattttattacgccgcaaaagatgcgcgccctcttcgaggacgcagaaagcggtgacatccgcgcccaacacgagcttttcgcggacattgaggagcgcgacagcgacatcgcggcaaatatggggacgcgcaaacgcgcgctgctgacgctcaactggcgcgtcgccccgccgcgaaatgcgacgcccgaagaagaaaagctgtccgaccaagcctacgaaatgatggacagcctgcctaccctcgaagacctgattatggatttgatggacgcggtagggcacggattttctgcgttggaggtcgagtgggtattttcagacggcctttacctaccccgaaactttatccaccgcccgcaaagctggttcaaatgggacaaagacaacgggctgctgctgcgtacccgcgaaaatccggaaggcgaagcgttgtggccgctgggctgggtcgttcatacccaaaaatcgcgcagcgtccagcaggcgcgcaacgggcttttccgcacgctttcctggctgtatatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtcacaacgcggcaggcatcatgccagaaggtatggaaatcgagctgcacaacgcggcaaacggcatgacttccgccggcaatccgtttttgcagatggccgactggtgcgaaaaatcggcggcgcggctgattttggggcaaacgctaaccagcggtgcggacggaaaatccagcaccaacgcgctgggcaatatccacaacgagatacgccgcgatttgctggtgtcggacgcaaaacaggtggcgcaaaccatcacaagccaaatcatcggaccgttcctgcaaatcaactatccccatgccgacccaaaccgcgtgccgaaatttgaatttgacacgcgcgagccgaaagacatcgcggtctttgccgacgctatcccgaaactggtggatgtcggcgtacaaatccccgaaagctgggtgcgcgacaaactggtcattccagatgtgcaggagggtgaggctgtgttggtgcggcaggtaccggacaatccggtaaacagaactgcattggcggctttatccgcccacaccgtaccatctaaggctacgggcaggcatcaggaaatattggacggcgcgttggatgacgcgctggttgagcccgatttcaattctcagctcaacccgatggtgcgtcaggcggttgccgcacttaatgcttgcaacagctacgaggaggcagatgccgcactgaatgcgctttatccgaatttggacaacgcgaaactgcgtacctatatgcagcaggccttgtttatcagcgatattttgggacaagaccatgcccgcgcctga

SEQ ID NO: 2422 - protein, 526 aa, Neisseria meningitidis
MEPIMAKKNNKTKIQKPEAALQTDVAQITATGRVIAEHPSNFITPQKMRALFEDAESGDIRAQHELFADIEERDSDIAANMGTRKRALLTLNWRVAPPRNATPEEEKLSDQAYEMMDSLPTLEDLIMDLMDAVGHGFSALEVEWVFSDGLYLPRNFIHRPQSWFKWDKDNGLLLRTRENPEGEALWPLGWVVHTQKSRSVQQARNGLFRTLSWLYMFKHYAVHDFAEFLELYGMPIRIGKYGAGATKEEKNTLLRAVAEIGHNAAGIMPEGMEIELHNAANGMTSAGNPFLQMADWCEKSAARLILGQTLTSGADGKSSTNALGNIHNEIRRDLLVSDAKQVAQTITSQIIGPFLQINYPHADPNRVPKFEFDTREPKDIAVFADAIPKLVDVGVQIPESWVRDKLVIPDVQEGEAVLVRQVPDNPVNRTALAALSAHTVPSKATGRHQEILDGALDDALVEPDFNSQLNPMVRQAVAALNACNSYEEADAALNALYPNLDNAKLRTYMQQALFISDILGQDHARA

SEQ ID NO: 2423 - DNA, 1581 bp, Neisseria meningitidis
atggagccgataatggcaaaaaagaacaataaaactaaaatccaaaagcccgaagctgcattgcagacggacgtggctcaaattacggcgaccggtcgggttatcgccgagcatccgtccaattttattacgccgcaaaagatgcgggccctcttcgaggacgcagaaagcggcgacatccgcgcccaacacgagcttttcgcggacattgaggagcgcgacagcgacatcgcggcaaatatggggacgcgcaaacgcgcgctgctgacgctcaactggcgcgtcgccccgccgcgaaatgcgacgcccgaagaagaaaagctgtccgaccaagcctacgaaatgatggacagcctgcctaccctcgaagacctgattatggatttgatggacgcggtagggcacggattttctgcgttggaggtcgagtgggtattttcagacggcctttacctaccccgaaactttatccaccgcccgcaaagctggttcaaatgggacaaagacaacgggctgctgctgcgtacccgcgaaaatccggaaggcgaagcgttgtggccgctgggctgggtcgttcatacccaaaaatcgcgcagcgtccagcaggcgcgcaacgggcttttccgcacgctttcctggctgtatatgttcaaacactacgccgtccacgattttgccgagtttttggagctgtacggcatgcccatccgtatcggcaaatacggcgcgggcgcaaccaaagaggaaaaaaacaccctgcttcgagcggtggcggaaatcggtcacaacgcggcaggcatcatgccagaaggtatggaaatagagctccacaacgcggcaaacggtacgacggcaaccagcaatccgtttttgcagatggccgactggtgcgaaaaatcggcggcgcggctgattttggggcaaacgctgaccagcggtgcggacggaaaatccagcaccaacgcgctgggcaatatccacaacgaggtacgccgcgatttgctggtgtcggacgcaaaacaggtggcgcaaaccatcacaagccaaatcatcggaccgttcctgcaaatcaactatccccatgccgacccaaaccgcgtgccgaaatttgaatttgacacgcgcgagccgaaagacatcgcggtctttgccgacgctatcccgaaactggtggatgtcggcgtacaaatccccgaaagctgggtgcgcgacaaactggtcattccagatgtgcaggagggtgaggctgtgttggtgcggcaggtaccggacaatccggtaaacagaactgcattggcggctttatccgcccacaccgtaccatctaaggctacgggcaggcatcaggaaatattggacggcgcgttggatgacgcgctggttgagcccgatttcaattctcagctcaacccgatggtgcgtcaggcggttgccgcacttaatgcttgcaacagctacgaggaggcagatgccgcactgaatgcgctttatccgaatttggacaacgcgaaactgcgtacctatatgcagcaggccttgtttatcagcgatattttgggacaagaccatgcccgcgcctga

SEQ ID NO: 2424 - protein, 526 aa, Neisseria meningitidis
MEPIMAKKNNKTKIQKPEAALQTDVAQITATGRVIAEHPSNFITPQKMRALFEDAESGDIRAQHELFADIEERDSDIAANMGTRKRALLTLNWRVAPPRNATPEEEKLSDQAYEMMDSLPTLEDLIMDLMDAVGHGFSALEVEWVFSDGLYLPRNFIHRPQSWFKWDKDNGLLLRTRENPEGEALWPLGWVVHTQKSRSVQQARNGLFRTLSWLYMFKHYAVHDFAEFLELYGMPIRIGKYGAGATKEEKNTLLRAVAEIGHNAAGIMPEGMEIELHNAANGTTATSNPFLQMADWCEKSAARLILGQTLTSGADGKSSTNALGNIHNEVRRDLLVSDAKQVAQTITSQIIGPFLQINYPHADPNRVPKFEFDTREPKDIAVFADAIPKLVDVGVQIPESWVRDKLVIPDVQEGEAVLVRQVPDNPVNRTALAALSAHTVPSKATGRHQEILDGALDDALVEPDFNSQLNPMVRQAVAALNACNSYEEADAALNALYPNLDNAKLRTYMQQALFISDILGQDHARA

SEQ ID NO: 2425 - DNA, 1581 bp, Neisseria meningitidis; identical to SEQ ID NO: 2421

SEQ ID NO: 2426 - protein, 526 aa, Neisseria meningitidis; identical to SEQ ID NO: 2422

SEQ ID NO: 2427 - DNA, 2172 bp, Neisseria meningitidis
atggcaaacgggaacatgaaactgtcgttggtgttaaccgcccgagatgacggagcgagacggctactggctgatactcaacgacaattagatcgtaccgcgaaatcgcgggcgcaacttgaacggcaaagccatacttatgcgttgaccggcatccgctcagaaaaacagattcaacgcgaaatcatgctgacacaggctgcgtttaaccgtttggcgcgcagcggcaaggcatcacaaaatgatttggcacgggcggcggtcgctacgcgtaaccgaattcgcgagctgaacgcggaactgaaacagggcacgggatttgcggacaagatgggaaaaatcggaagattcggtgcagctgcggtggctggtggcgcggcagcgtatacggtgcttaagcctgctatggacaacagaaagcagcttgatgagaacatcaaccgcgtgtccagacaggcatttattgaggataacagtaaatcggcagcgtggattgcaactgaaggtgcgcaacagatcaaggatttggcacttgaacttgtcgagaaaaatggcgggacccacgataaggctttggatttaatcagcggcatgatgaccaccggtctgaattttgcccaaaccaagaatgaagcgcaggcggcatatgcttttgcacttgcctcagaaggcagtggcgaggatacggcaaaactgattaaaaccctgaaagatggcggcatgagcggtaaagacctgcaactcgggcttgagcacgtcttgcaatcgggtttagacggcactttcgaggtgcgggatatggttcgggagctgccgagcctgctctctgccgcgcaacaggcagggatgaatggtgtcggcggtttggactacctgctctcactcttacaatctgcggcgaataaatcgggcagtcctgccgaagcggcgactaatgtgcaaaatcttttgagtaaaactctgtcgcctgacacgataggtcgtctgaagaagatggcaaatccgaatgacccgaagaaaggtgtcgattggataggctcggttgtgcaaggcaagcaaaacggcgaaaacgcagtgcaggtgttgtcccgtcttgccgatgccatgctagtaaaggataagcaataccaagattataagaaacgcgcggctgcaggcgataagacggcggcggagcaggcaaatatgcttaagggcgcgcttttggcgcaactgctgcctgatttgcaggcaaaacaaggtttgctggctgcaacggatatgacgcaaatccgtgaatatatggcttcgttggctggcgtaacgttggataacggaaaaattgctaagaacaacgaggcgcgaatgttgtcggcagcggcgcaacaagagcaacaggaatcgctggcaatgttgcgggaaagtctgacgggaacattggtggatatggaaacctcgtttaaaaagctggcagcggaataccctaatgccactctagccctgcaagcattgacgacggcggcaacagcggcgtctgccgcaatgttattaaccgccggtggcggtaaaggtgcaggctttctgaaagatgtaggtagtaaagcgttgggatggggtaaggcttccgcaggcggcgtggcagcaggtgccacagcggcaggcggtaagttgctgtcatggggaaaatctgccggtagcgggctcatgaataatccagcgttagttaaacgggcgggtttgttaggtatgttgctgtattccgagtctttgggtgacggcacattgccaaagggtttgcgtggtaccaagacaactcctgaaatgattaatcgtctgaaaaacaacggtatccgatttgaacctgcgccgaagcgggaacaggcgcggggtggtgtccctcagtatttggctgctccgtcagcgcagcctaccgataagatgttgtctccgttgttttcaactcagacggcggcgtatcaggcagccattcagcagcagacggcggcgtatcaggcagcattggcgcaggatacggctgcagttacaacaggtttggcacaagtgcaaagtgcgatggcgtcggcaagtcagaccatcaataccaatgtgagcctgaatatcgacggacgtgttatcgcgaatgaggtatcgcggtatcaagtggccatgttcggccgtggagcgggtcaataa

SEQ ID NO: 2428 - protein, 723 aa, Neisseria meningitidis
MANGNMKLSLVLTARDDGARRLLADTQRQLDRTAKSRAQLERQSHTYALTGIRSEKQIQREIMLTQAAFNRLARSGKASQNDLARAAVATRNRIRELNAELKQGTGFADKMGKIGRFGAAAVAGGAAAYTVLKPAMDNRKQLDENINRVSRQAFIEDNSKSAAWIATEGAQQIKDLALELVEKNGGTHDKALDLISGMMTTGLNFAQTKNEAQAAYAFALASEGSGEDTAKLIKTLKDGGMSGKDLQLGLEHVLQSGLDGTFEVRDMVRELPSLLSAAQQAGMNGVGGLDYLLSLLQSAANKSGSPAEAATNVQNLLSKTLSPDTIGRLKKMANPNDPKKGVDWIGSVVQGKQNGENAVQVLSRLADAMLVKDKQYQDYKKRAAAGDKTAAEQANMLKGALLAQLLPDLQAKQGLLAATDMTQIREYMASLAGVTLDNGKIAKNNEARMLSAAAQQEQQESLAMLRESLTGTLVDMETSFKKLAAEYPNATLALQALTTAATAASAAMLLTAGGGKGAGFLKDVGSKALGWGKASAGGVAAGATAAGGKLLSWGKSAGSGLMNNPALVKRAGLLGMLLYSESLGDGTLPKGLRGTKTTPEMINRLKNNGIRFEPAPKREQARGGVPQYLAAPSAQPTDKMLSPLFSTQTAAYQAAIQQQTAAYQAALAQDTAAVTTGLAQVQSAMASASQTINTNVSLNIDGRVIANEVSRYQVAMFGRGAGQ

SEQ ID NO: 2429 - DNA, 1332 bp, Neisseria meningitidis
atgagcggatggcataccttattgcaggacgcatcttacaagggcgtcggctttgatattgaggtggtggacgagagcaacggcaaggcattggccgagcatgcgcggccgtttgtgcagggtatcgaccttgaagacatgggcatgaccgggcggcaggtgcagattaatgcggtgttttggggcaagggctatgcaggccgtctgaaaaagctgctggatgcgctggagcagccgggcggcggcgtgctggtgcaccctgtttgggggcggatgcacaacatgattgcggcatcatggagttaccgacatgaggccgattatgtggattatgcgggcatcgatattactttccgcgaggcggccgaagcgcaggaaatctttgtttttgaaaacgcctttttggtcgagcttgaggcgttgattgctaatatcgacacctaccgcgaggcggctatcggctttgttgatgcggtgttggcggtggatgcgggcgtatcagctttatggggcagcgcgctgggcatttggagtgcggcatcgggtacgtttggcgcggtgcgccgtttgtttgatttggacaaaattgcctttcccgatcggggcggatacagtgcagcggcgtttaaaaacggctcggccaagctgtttgcggatatatcggtcatggtagatactggcatacgccgtgaggcgggtttggccgataatgccatgcaccatgccggttggtcgccgcgacagcggtttgacggggctgcggctgttgccgaccgcgccgccgctatccctgataatttgctgaccggccgcttttcagacggcctgcaaaaccgcctgaaccggttaaccgccaaacaggtgcagccggtagcgcaggcggtgcgcctgttatccacgtcatcgctgttgtcggtggcaacggcattaatcgaggcgcatggcgaagagatgaccgcgcccgatttgattgaggttaaccgcgccatgcgccgccgtatgcaggccgagattgccgccttgcgggcggtgcagacggctgctgccgagtctggtgggctgacggccaacgccgtgtataccgaggcttaccaaacggcagaatccctgcgcgcggcggcaggccgtctgaatgcgttggttgcggcggtcatcaaccaaaagccgccgctgattgtgcgccaagccccaatcgacggtacgatacaccaaatcgcccacgagttttacggcgatatagcccgcgcagcagagctggtgcggctcaatccccatatccaccaccccgcgtttatcaagcgcggcactttggtcaacagctatgcaaaataa

SEQ ID NO: 2430 - protein, 443 aa, Neisseria meningitidis
MSGWHTLLQDASYKGVGFDIEVVDESNGKALAEHARPFVQGIDLEDMGMTGRQVQINAVFWGKGYAGRLKKLLDALEQPGGGVLVHPVWGRMHNMIAASWSYRHEADYVDYAGIDITFREAAEAQEIFVFENAFLVELEALIANIDTYREAAIGFVDAVLAVDAGVSALWGSALGIWSAASGTFGAVRRLFDLDKIAFPDRGGYSAAAFKNGSAKLFADISVMVDTGIRREAGLADNAMHHAGWSPRQRFDGAAAVADRAAAIPDNLLTGRFSDGLQNRLNRLTAKQVQPVAQAVRLLSTSSLLSVATALIEAHGEEMTAPDLIEVNRAMRRRMQAEIAALRAVQTAAAESGGLTANAVYTEAYQTAESLRAAAGRLNALVAAVINQKPPLIVRQAPIDGTIHQIAHEFYGDIARAAELVRLNPHIHHPAFIKRGTLVNSYAK

SEQ ID NO: 2431 - DNA, 510 bp, Neisseria meningitidis
ggcctgcaaaaccgcctgaaccggttaaccgccaaacaggtgcagccggtagcgcaggcggtgcgcctgttatccacgtcatcgctgttgtcggtggcaacggcattaatcgaggcgcatggcgaagagatgaccgcgcccgatttgattgaggttaaccgcgccatgcgccgccgtatgcaggccgagattgccgccttacgggcggtgcagacggctgctgccgagtctggtgggctgacggccaacgccgtgtataccgaggcttaccaaacggcagaatccctgcgcgcggcggcaggccgtctgaatgcgttggttgcggcggtcatcaaccaaaagccgccgctgattgtgcgccaagccccaatcgacggtacgatacaccaaatcgcccacgagttttacggcgatatagcccgcgcagcagagctggtgcggctcaatccccatatccaccaccccgcgtttatcaagcgcggcactttggtcaacagctatgcaaaataa

SEQ ID NO: 2432 - protein, 169 aa, Neisseria meningitidis
GLQNRLNRLTAKQVQPVAQAVRLLSTSSLLSVATALIEAHGEEMTAPDLIEVNRAMRRRMQAEIAALRAVQTAAAESGGLTANAVYTEAYQTAESLRAAAGRLNALVAAVINQKPPLIVRQAPIDGTIHQIAHEFYGDIARAAELVRLNPHIHHPAFIKRGTLVNSYAK

SEQ ID NO: 2433 - DNA, 1062 bp, Neisseria meningitidis
atgtccaaaaatgcacaaaaaaccctacttgccgtgtgcagtttcgaggtgcagccaaaagacgggcgaatccaactgctgccatatggcgaatttcgcgcagtagacggtcgtccgactgatgtccctgcgtggtatctgaccgaagaaaacggtcatgatgtcgcgttgttggccaacagctcgcgcaatcagttggttgtcgattatgaacaccagacgctctacaaagagaaaaacggacaacctgcacctgccgccggttggatgcgttggctggagttcacgcctaaaggcatgtttgccgaagtggagtggacggacaaggcggctgcggcaattgccgcaaaagagtatcgctacatctctgctgtgttttcctatgacacaaagggatatgtaagcaaaatttttcacgccgcgctgacaaatttccccgcgttggacggtatggacgaggtgctggcggcagcgtcggcgcaaattttaaaaccggaaacggagcaaaaccctatgaaagagttgttacagcaactgttcgacctgcctgatgcgggcgaagaagaactgaaggcggcattgtccgcgctcgtggaagccaagccgaaagacgtggcattgtctgccgacgtgttcgcgcagctggcggaaaaagacagccgcatcgcggcattgacggcgcaaaccgccaagcctgatttgactaaatacgcgcctatctcagtggttcaagagctgcaaagcaaagtcgccgcgctgactgccaagcaggaagcagacaaaggcaacgaattgattaccgccgcgctgacttcaggcaaattgctgcctgctcagaaggagtgggcaaaaggcgtattgaaacagccgggcggcttggcatttttgaccggctttattgaaaacgcccagccggtcgctgcactggcaggctcgcaaacgggcggcaaagcacccgacgaacgcgtcgccgcactgactgcggaagaggcagccgcagcaaaaatgctgggcatgtccggcgaagaatttgtaaaaatcaaagaaagcgaaggtaagtaa

SEQ ID NO: 2434 - protein, 353 aa, Neisseria meningitidis
MSKNAQKTLLAVCSFEVQPKDGRIQLLPYGEFRAVDGRPTDVPAWYLTEENGHDVALLANSSRNQLVVDYEHQTLYKEKNGQPAPAAGWMRWLEFTPKGMFAEVEWTDKAAAAIAAKEYRYISAVFSYDTKGYVSKIFHAALTNFPALDGMDEVLAAASAQILKPETEQNPMKELLQQLFDLPDAGEEELKAALSALVEAKPKDVALSADVFAQLAEKDSRIAALTAQTAKPDLTKYAPISVVQELQSKVAALTAKQEADKGNELITAALTSGKLLPAQKEWAKGVLKQPGGLAFLTGFIENAQPVAALAGSQTGGKAPDERVAALTAEEAAAAKMLGMSGEEFVKIKESEGK

SEQ ID NO: 2435 - DNA, 1062 bp, Neisseria meningitidis
atgtccaaaaatgcacaaaaaaccctacttgccgtgtgcagtttcgaggtgcagccaaaagacgggcgaatccaactgctgccatatggcgaatttcgcgcagtagacggtcgtccgactgatgtccctgcgtggtatctgaccgaagaaaacggtcatgatgtcgcgttgttggccaacagctcgcgcaatcagttggttgtcgattatgaacactagacgctctacaaagagaaaaacggacaacctgcacctgccgccggttggatgcgttggctggagttcacgcctaaaggcatgtttgccgaagtggagtggacggacaaggcggctgcggcaattgccgcaaaagagtatcgctacatctctgctgtgttttcctatgacacaaagggatatgtaagcaaaatttttcacgccgcgctgacaaatttccccgcgttggacggtatggacgaggtgctggcggcagcgtcggcgcaaattttaaaaccggaaacggagcaaaaccctatgaaagagttgttacagcaactgttcggtctgcctgatgcgggcgaagaagaactgaaggcggcattgtccgcgctcgtggaagccaagccgaaagacgtggcattgtctgccgacgtgttcgcgcagctggcggaaaaagacagccgcatcgcggcattgacggcgcaaaccgccaagcctgatttgactaaatacgcgcctatctcagtggttcaagagctgcaaagcaaagtcgccgcgctgactgccaagcaggaagcagacaaaggcaacgaattgattaccgccgcgctgacttcaggcaaattgctgcctgctcagaaggagtgggcagaaggcgtattgaaacagccgggcggcttggcatttttgaccggctttattgaaaacgcccagccggtcgctgcactggcaggctcgcaaacgggcggtaaagcacccgacgaacgcgtcgccgcactgactgcggaagaggcagccgcagcaaaaatgctgggcatgtccggcgaagaatttgtaaaaatcaaagaaagcgaaggtaagtaa

SEQ ID NO: 2436 - protein, 352 aa, Neisseria meningitidis
MSKNAQKTLLAVCSFEVQPKDGRIQLLPYGEFRAVDGRPTDVPAWYLTEENGHDVALLANSSRNQLVVDYEHTLYKEKNGQPAPAAGWMRWLEFTPKGMFAEVEWTDKAAAAIAAKEYRYISAVFSYDTKGYVSKIFHAALTNFPALDGMDEVLAAASAQILKPETEQNPMKELLQQLFGLPDAGEEELKAALSALVEAKPKDVALSADVFAQLAEKDSRIAALTAQTAKPDLTKYAPISVVQELQSKVAALTAKQEADKGNELITAALTSGKLLPAQKEWAEGVLKQPGGLAFLTGFIENAQPVAALAGSQTGGKAPDERVAALTAEEAAAAKMLGMSGEEFVKIKESEGK

SEQ ID NO: 2437 - DNA, 1056 bp, Neisseria meningitidis
gtgtttgaaacgccgacatttgagcaaatccgcgagcgtatcctgcgcgataccaaaagcctgtggccggatgccgatatcagccccgacagcgaccattatgtgcacgccagccgtttggccagctgcgccgaagggcaatatgcgcatcaaagctggattgtgcggcagattttccctgataccgccgaccgcgagtatttggagcggcatgcctccatgcgcggcttgagccgccgcaatcctaccacggccagcggcacgctgaccgtaagcggtattgcgcaatccatgctttcagacgacctgcaagtgcgtatcggccagcgtttttaccgcactaccgcccgcgccgttatcggcagcggcggcacggcggaaataccggcaatcgccgacgagccgggcgcggccgccaatgtgggcgacggcgaggcgcaactgatggccgcccccgccggtgtggccaccgaatgccgccttaccgtacaaggcggcaccgaccgagaaagcgatgcctcactgctggcgcgtctgttggaaatcatccgccgaccgcccgcaggcggcaaccgttacgactataaaaactgggcgttgagtgttgacggcgtaaccagcgcatatgtttatccgctgcgccgcggcttgggtacggtggatattgccattacctccgccgacggtgtgtcgtcggaagaaactgtgcgccgcgtacaggcttatatcgacgagatgcgcccggtaacggcaaaaaatgcgctggtactcaagccaaccgtaacggcggtgcctgttaccgtgcaagtcaagctcgacggtatcgacttggacgaggccaagcgccgcatacggacggccctaaaagaatatttcgacaccctgatccccggcgacggcctgactgtgtcgcaaatcgaggctgctatcagcaatgtggatggtgtgatcgaccgccgtctgactgcgccgacggccaaccgtgccgccgatacggttaaccgcatcgagtggtttaaagcgggcgcgattaatgtaacggagatgccgtcatga

SEQ ID NO: 2438 - protein, 351 aa, Neisseria meningitidis
VFETPTFEQIRERILRDTKSLWPDADISPDSDHYVHASRLASCAEGQYAHQSWIVRQIFPDTADREYLERHASMRGLSRRNPTTASGTLTVSGIAQSMLSDDLQVRIGQRFYRTTARAVIGSGGTAEIPAIADEPGAAANVGDGEAQLMAAPAGVATECRLTVQGGTDRESDASLLARLLEIIRRPPAGGNRYDYKNWALSVDGVTSAYVYPLRRGLGTVDIAITSADGVSSEETVRRVQAYIDEMRPVTAKNALVLKPTVTAVPVTVQVKLDGIDLDEAKRRIRTALKEYFDTLIPGDGLTVSQIEAAISNVDGVIDRRLTAPTANRAADTVNRIEWFKAGAINVTEMPS

SEQ ID NO: 2439 - DNA, 1056 bp, Neisseria meningitidis
gtgtttgaaacgccgacatttgagcaaatccgcgagcgtatcctgcgcgataccaaaagcctgtggccggatgccgatatcagccccgacagcgaccattatgtgcacgccagccgtttggccagctgcgccgaagggcaatatgcgcatcaaagctggattgtgcggcagattttccctgataccgccgaccgcgagtatttggagcggcatgcctccatgcgcggcttgcgccgccgcaatcctaccacggccagcggcacgctgaccgtaagcggtattgcgcaatccatgctttcagacggcctgcaagtgcgtatcggccagcgtttttaccgcactaccgcccgcgccgttatcggcagcggcggcacggcggaaataccggcaatcgccgacgagccgggcgcggccgccaatgtgcgcgacggcgaggcgcaactgatggccgcccccgccggtgtgtccaccgaatgccgccttaccgtacaaggcggcaccgaccgagaaagcgatgcctcactgctggcgcgtctgttggaaatcatccgccgaccgcccgcaggcggcaaccgttacgactataaaaactgggcgttgagtgttgacggcgtaaccagcgcatatgtttatccgctgcgccgcggcttgggtacggtggatattgccattacctccgccgacggtgtgccatcggaagaaactgtgcgccgcgtacaggcttatatcgacgagatgcgcccggtaacggcaaaaaatgcgctggtactcaagccaaccgtaacggcggtgcctgttaccgtgcaagtcaagctcgacggcatcgacttggacgaggccaagcgccgcatacggacggccctaaaagaatatttcgacaccctgatccccggcgacggcctgactgtgtcgcaaatcgaggcggctatcagcaatgtggatggtgtgatcgacctccgtctgactgcgccgacggccaaccgtgccgccgatacggttaaccgcatcgagtggtttaaagcgggcgcgattaatgtaacggagatgccgtcatga

SEQ ID NO: 2440 - protein, 351 aa, Neisseria meningitidis
VFETPTFEQIRERILRDTKSLWPDADISPDSDHYVHASRLASCAEGQYAHQSWIVRQIFPDTADREYLERHASMRGLRRRNPTTASGTLTVSGIAQSMLSDGLQVRIGQRFYRTTARAVIGSGGTAEIPAIADEPGAAANVRDGEAQLMAAPAGVSTECRLTVQGGTDRESDASLLARLLEIIRRPPAGGNRYDYKNWALSVDGVTSAYVYPLRRGLGTVDIAITSADGVPSEETVRRVQAYIDEMRPVTAKNALVLKPTVTAVPVTVQVKLDGIDLDEAKRRIRTALKEYFDTLIPGDGLTVSQIEAAISNVDGVIDLRLTAPTANRAADTVNRIEWFKAGAINVTEMPS

SEQ ID NO: 2441 - DNA, 909 bp, Neisseria meningitidis
atgcgacccaagccccgtttcagacggtctgttatcgcttgctcaatatcagtgatcacgcccgaacaccttatttttaccgtttacaaacacaataccgtcttcgcccgcggccacttcttcgccgctatcatccacgcccagctgcacttcgcctttggccatagcacgcagcaggtcgagcacgtcgattttgtagcggttgcggatttcgtcggtaatcaacacgccctgagccgccgtcagacggtagcgggcaatgtcgcagcaaaggcgcaccaagatgggcggcagatcctcaaaaggtcgtctgaaccgccccagatacgcgtcgatttcggcagtggcgtccaccagcgcggtttgtgcgacctcgcggtcaatcagcccctcgttgttgcggtcggtgagctgcaagacttccagctcaccgaaacgcgcaaccatatcctcaaccgtcgcgtatgccattactcgaccgccttgcgttgcagcataggctcggcgcagattgccttccacaccgcttcgccgacttcggcgcgcttcacttcgcgccagccgccgtcaaacagcaggccgccgcgccaaaattctttgccgtctgcgccggtactgacgagcatcacatcgcggctgtccgccaaagcgtcggcggcacgttgcgtatgctgcactttgagttcggcaagttcggcggacagtgcctttttgtcgtcttcggctttttccaaggctgtggtcagcatttcgacatcgtttcgggcggcggcaagctctgcctgcacggcgtccaattcggctttgatgtcttcaaacgacggggcggcggtttcggcggtttctggtttgttgttggtttttgccatgatgactccttgtttcagacggcggcggattcgcatttga

SEQ ID NO: 2442 - protein, 302 aa, Neisseria meningitidis
MRPKPRFRRSVIACSISVITPEHLIFTVYKHNTVFARGHFFAAIIHAQLHFAFGHSTQQVEHVDFVAVADFVGNQHALSRRQTVAGNVAAKAHQDGRQILKRSSEPPQIRVDFGSGVHQRGLCDLAVNQPLVVAVGELQDFQLTETRNHILNRRVCHYSTALRCSIGSAQIAFHTASPTSARFTSRQPPSNSRPPRQNSLPSAPVLTSITSRLSAKASAARCVCCTLSSASSADSAFLSSSAFSKAVVSISTSFRAAASSACTASNSALMSSNDGAAVSAVSGLLLVFAMMTPCFRRRRIRI

SEQ ID NO: 2443 - DNA, 669 bp, Neisseria meningitidis
atgagtttgagtaaattggcgaaaaaaacggcacaaactgctaaaaatatcggcgaaaccctgcgcgcggcctttcggggaaaaatcacgctggtggtgtcgtccgagccgatacagcgcgtgcagttgagcggcttggccgacgaaaccctgcaagaccttgaacatttgcaggaatacggctttgccagccatccgcccgacggcagcgaagcggtagtgataccgctgggcggcaatacttcgcacggtgtgattgtgtgcagccagcacggcagctaccgcatcaaaaaccttaagcccggcgagacggcgatttttaatcatgagggtgcaaaaatcgtgattaagcaaggcaaaatcattgaggccgattgcgacgtgtaccgggttaactgcaaacaatacgaggttaatgcggccacggatgccaaatttaacgctccgttggtggagaccagtgcagtgttgacggcgcaaggccaaatcaacggcaacggcggcatggccgtcgagggcggcgacggagccacctttagcggcgatgttaaccaaacgggcggcagctttaacaccgacggcgacgtggtggccggcaatatatcgttgcgccagcacccgcataccgacagcatcggcggcaaaaccttaccggcggaaccggcatag

SEQ ID NO: 2444 - protein, 222 aa, Neisseria meningitidis
MSLSKLAKKTAQTAKNIGETLRAAFRGKITLVVSSEPIQRVQLSGLADETLQDLEHLQEYGFASHPPDGSEAVVIPLGGNTSHGVIVCSQHGSYRIKNLKPGETAIFNHEGAKIVIKQGKIIEADCDVYRVNCKQYEVNAATDAKFNAPLVETSAVLTAQGQINGNGGMAVEGGDGATFSGDVNQTGGSFNTDGDVVAGNISLRQHPHTDSIGGKTLPAEPA

SEQ ID NO: 2445 - DNA, 669 bp, Neisseria meningitidis; identical to SEQ ID NO: 2443

SEQ ID NO: 2446 - protein, 222 aa, Neisseria meningitidis; identical to SEQ ID NO: 2444

SEQ ID NO: 2447 - DNA, 594 bp, Neisseria meningitidis
atggtgcgcacggttaaaagctacaacggcgaggccgacgatttggcggggcaaatccatacgctgcctgcggtttgggtaacgtatggcggcagcaaagttgagcctgccagcaccggcggcgtatgcggacgttatcaggataccgccgaatttgtggtgatggtggcggcccgcaatctgcgcaacgagcaggcgcagcggcaaggcggcatcgacagccgcgaaatcggcagcaacgatttaatccgcgctgttcgccgcctgcttgacggccagcggctcggttttgccgatagccgcggcttggtgcccaaagcggtgcgcgcgattgccaatcatgtgctggtgcaaaacgccgcagtaagcatatatgcggttgagtatgccatccgctttaacacctgcgggttggaaaatgaccgctaccccgaacgcaccgacaatcccgacgaccccaaccatatctttaccaagtatcagggtacattgagcgagccgtggcctgatttcgaggggttggacggcaaaatttacgacccgcaatccgccgatgaaatacctgtaaacctaacccttaaggataagcaatga

SEQ ID NO: 2448 - protein, 197 aa, Neisseria meningitidis
MVRTVKSYNGEADDLAGQIHTLPAVWVTYGGSKVEPASTGGVCGRYQDTAEFVVMVAARNLRNEQAQRQGGIDSREIGSNDLIRAVRRLLDGQRLGFADSRGLVPKAVRAIANHVLVQNAAVSIYAVEYAIRFNTCGLENDRYPERTDNPDDPNHIFTKYQGTLSEPWPDFEGLDGKIYDPQSADEIPVNLTLKDKQ

SEQ ID NO: 2449 - DNA, 606 bp, Neisseria meningitidis
atgaccatctatttcaaaaacggcttttacgacgacacattgggcggcatccccgaaggcgcggttgccgtccgcgccgaagaatacgccgcccttttggcaggacaggcgcagggcgggcagattgccgcagattccgacggccgccccgttttaaccccgccgcgcccgtccgattaccacgaatgggacggcaaaaaatggaaaatcagcaaagccgccgccgccgcccgtttcgccaaacaaaaaaccgccttggcattccgcctcgcggaaaaggcggacgaactcaaaaacagcctcttggcgggctatccccaagtggaaatcgacagcttttacaggcaggaaaaagaagccctcgcgcggcaggcggacaacaacgccccgaccccgatgctggcgcaaatcgccgccgcaaggggcgtggaattggacgttttgattgaaaaagttatcgaaaaatccgcccgcctggctgttgccgccggcgcgattatcggaaagcgtcagcagctcgaagacaaattgaacaccatcgaaaccgcgcccggattggacgcgctggaaaaggaaatcgaagaatggacgctaaacatcggctga

SEQ ID NO: 2450 - protein, 201 aa, Neisseria meningitidis
MTIYFKNGFYDDTLGGIPEGAVAVRAEEYAALLAGQAQGGQIAADSDGRPVLTPPRPSDYHEWDGKKWKISKAAAAARFAKQKTALAFRLAEKADELKNSLLAGYPQVEIDSFYRQEKEALARQADNNAPTPMLAQIAAARGVELDVLIEKVIEKSARLAVAAGAIIGKRQQLEDKLNTIETAPGLDALEKEIEEWTLNIG

SEQ ID NO: 2451 - DNA, 606 bp, Neisseria meningitidis
atgaccatctatttcaaaaacggcttttacgacgacaccttgggcagcatccccgaaggcgcggttgccgtccgcgccgaagaatacgccgcccttttggcaggacaggcgcagggcgggcagattgccgcagattccgacggccgccccgttttaaccccgccgcgcccgtccgaataccacgaatgggacggcaagaaatgggaaatcggcgaagccgctgccgccgcccgtttcgccgaacaaaaaaccgccacggcattccgcctcgcggcaaaggcggacgaactcaaaaacagcctcttggcgggctatccccaagtggaaatcgacagcttttacaggcaggaaaaagaagccctcgcgcggcaggcggacaacaacgccccgaccccgatgctggcgcaaatcgccgccgcaaggggcgtggaattggacgttttgattgaaaaagttgtcgaaaaatccgcccgcctggccgttgccgccggcgcgattatcggaaagcggcagcagctcgaagacaaattgaacaccatcgaaaccgcgccaggattggacgcgctggaaaaggaaatcgaagaatggacgctaaacatcggctga

SEQ ID NO: 2452 - protein, 201 aa, Neisseria meningitidis
MTIYFKNGFYDDTLGSIPEGAVAVRAEEYAALLAGQAQGGQIAADSDGRPVLTPPRPSEYHEWDGKKWEIGEAAAAARFAEQKTATAFRLAAKADELKNSLLAGYPQVEIDSFYRQEKEALARQADNNAPTPMLAQIAAARGVELDVLIEKVVEKSARLAVAAGAIIGKRQQLEDKLNTIETAPGLDALEKEIEEWTLNIG

SEQ ID NO: 2453 - DNA, 405 bp, Neisseria meningitidis
atgaatctcgtgaaactgctggcgaataactggcaaccgattgccattatcgcgcttgtcggcacgggcttggctgtgtcgcaccatcaaggctacaagtcggcatttgcgaagcagcaggcggtcatcgacaagatggagcgcgacaaggcgcaagccctgctgttgtcggctcaaaactatgcgcgcgaactggaactggcacgcgcggaagctaaaaaatatgaagtcaaggcgcacgctgtcggcatggctttggcgaaaaaacaggcggaagtcagccgtctgaaaacggaaagagacctttgcaaaattcctttccctcccgacagccgaaacccaaacacaggttttcggctgttttcgccccaaataccgcctaattttacccaaatacccccttaa

SEQ ID NO: 2454 - protein, 134 aa, Neisseria meningitidis
MNLVKLLANNWQPIAIIALVGTGLAVSHHQGYKSAFAKQQAVIDKMERDKAQALLLSAQNYARELELARAEAKKYEVKAHAVGMALAKKQAEVSRLKTERDLCKIPFPPDSRNPNTGFRLFSPQIPPNFTQIPP

SEQ ID NO: 2455 - DNA, 420 bp, Neisseria meningitidis
atgaatctcgtgaaactgctggcgaataactggcaaccgattgccatcatcgcgcttgtcggcacgggtttggcggtgtcgcaccatcaaggctacaagtcggcttttgcgaagcagcaggcggtcattgagaaaatgaagcgcgacaaggcgcaagccctgctgttgtcggctcaaaactacgcccgcgaactggaacaggcgcgtgcggaagctaaaaaatatgaagtcaaggcgcacgccgtcggcatggctttggcgaaaaaacaggcggaagtcagccgtctgaaaacggaaaataaaaaggaaatcgaaaatgtccttactcaagaccgtaaaaatgcaggcggcggttgtattgacggctttggccatcacggcttgcagctctacaagcgcgccctcggctacggaaattaa

SEQ ID NO: 2456 - protein, 139 aa, Neisseria meningitidis
MNLVKLLANNWQPIAIIALVGTGLAVSHHQGYKSAFAKQQAVIEKMKRDKAQALLLSAQNYARELEQARAEAKKYEVKAHAVGMALAKKQAEVSRLKTENKKEIENVLTQDRKNAGGGCIDGFGHHGLQLYKRALGYGN

SEQ ID NO: 2457 - DNA, 1134 bp, Neisseria gonorrhoeae
atgtttaaaaaattcaaaccggtactgttgtcattttttgcacttgtatttgccttttggctgggaacaggtattgcctatgagattaatccgcgttggtttttgagcgatacggcaactgaagtacctgaaaatccgaatgcttttgtggcgaaacttgcccgcctgttccgaaatgccgacagggcggttgtcatcgtgaaggaatcgatgaggacggaggaaagccttgccggagctgtggatgacggtccgttgcagtcggagaaggattatctcgcgctcgctatccggctcagtcgtttgaaagaaaaggcgaaatggtttcacgtaacggagcaggaacatggggaagaggtttggctggattactatatcggcgagggcggtttggttgcggtttcgctttcgcaacgctcgccggaagcgtttgttaatgccgaatatctgtatcggaacgatcgtccgttttctgtaaatgtgtacggcggaacggctcacggggaaaattatgaaacgacaggagaatatcgggttgtttggcaaccggacggttcggtatttgatgcggcggggcgcgggaaaatcggggaagatgtttatgagcattgcctcgggtgttatcagatggcccaggtatatttggcgaaataccgggatgtcgcgaatgacgagcagaaggtttgggacttccgcgaagagagcaaccggattgcatcggactcgcgcgattatgtgttttatcagaatatgcgggaattgatgccccgggggatgaaggcgaacagtcttgtggtcggctatgatgcggacggtctgccgcaaaaagtctattggagtttcgacaatggaaaaaaacgccagagtttcgaatattatttgaaaaacggaaatctttttattgcacaatcttcgacggtagcattgaaagcggatggcgtaacggcggatatgcagacctatcatgcgcaacagacgtggtatttggatggcgggcggattatccgcgaagagaaacagggagacagactgcctgattttcctttgaacttggaagatttggaaaaagaggtgagccgttatgcagaggctgcggcgagacgttcgggcggcaggcgcggcctttctcactga

SEQ ID NO: 2458 - protein, 377 aa, Neisseria gonorrhoeae
MFKKFKPVLLSFFALVFAFWLGTGIAYEINPRWFLSDTATEVPENPNAFVAKLARLFRNADRAVVIVKESMRTEESLAGAVDDGPLQSEKDYLALAIRLSRLKEKAKWFHVTEQEHGEEVWLDYYIGEGGLVAVSLSQRSPEAFVNAEYLYRNDRPFSVNVYGGTAHGENYETTGEYRVVWQPDGSVFDAAGRGKIGEDVYEHCLGCYQMAQVYLAKYRDVANDEQKVWDFREESNRIASDSRDYVFYQNMRELMPRGMKANSLVVGYDADGLPQKVYWSFDNGKKRQSFEYYLKNGNLFIAQSSTVALKADGVTADMQTYHAQQTWYLDGGRIIREEKQGDRLPDFPLNLEDLEKEVSRYAEAAARRSGGRRGLSH

SEQ ID NO: 2459 - DNA, 1134 bp, Neisseria meningitidis
atgtttaaaaaattcaaaccggtactgttgtcattttttgcacttgtatttgccttttggctgggaacgggtattgcctatgagattaatccgcgttggtttttgagcgatacggcaactgaagtacctaaaaatccgaatgcttttgtggcgaaacttgcccgcctgttccgaaatgccgacagggcggttgtcatcgtgaaggaatcgataaggacggaggaaaatcttgccggaactgtggatgacggtccgttgcagtcggagaaggattatctcgcgctcgctatccggctcagtcgtttgaaagaaaaggcgaaatggtttcacgtaacggagcaggaacatgggaaagaggtttggctggattaccatatcggcgagggcggtttggttgcggtttcgctttcgcaacgctcgccggaagcatttgttaatgccgaatatctgtatcggaacgatcgtccgttttctgtaaatgtgtacggcggaacggttcacggggaaaattatgaaacgacaggagaatatcgggttgtttggcaaccagacggttcggtatttgatgcggcggggcgcgggaaaatcggggaagatgtttatgagcattgcctcgggtgttatcagatggcccaggtatatttggcgaaataccgggatgtcgcgaatgacgagcagaaggtttgggacttccgcaaagagagcaaccgaattgcgtcggactcgcgcaattctgtgttttatcagaatatgcgggaattgatgccccgagggatgaaggcgaacagtcttgtggtcggctatgatgcggacggtctgccgcaaaaagtctattggagtttcgacaatggaaaaaaacgccagagtttcgaatattatttgaaaaacggaaatctttttattgcacaatcttcgacggtagcattgaaagcggatggcgtaacggcggatatgcagacctatcatgcgcaacagacgtggtatttggatggcgggcggattgtccgcgaagagaaacagggagacagactgcctgattttcctttgaacttggaaaatttggaaaaagaggtgcgccgttatgcagaggctgcggcgagacgttcgggcggcaggcgcgacctttctcactga

SEQ ID NO: 2460 - protein, 377 aa, Neisseria meningitidis
MFKKFKPVLLSFFALVFAFWLGTGIAYEINPRWFLSDTATEVPKNPNAFVAKLARLFRNADRAVVIVKESIRTEENLAGTVDDGPLQSEKDYLALAIRLSRLKEKAKWFHVTEQEHGKEVWLDYHIGEGGLVAVSLSQRSPEAFVNAEYLYRNDRPFSVNVYGGTVHGENYETTGEYRVVWQPDGSVFDAAGRGKIGEDVYEHCLGCYQMAQVYLAKYRDVANDEQKVWDFRKESNRIASDSRNSVFYQNMRELMPRGMKANSLVVGYDADGLPQKVYWSFDNGKKRQSFEYYLKNGNLFIAQSSTVALKADGVTADMQTYHAQQTWYLDGGRIVREEKQGDRLPDFPLNLENLEKEVRRYAEAAARRSGGRRDLSH

SEQ ID NO: 2461 - DNA, 1125 bp, Neisseria meningitidis
atgtttaaaaaattcaaaccggtactgttgtcattttttgcacttgtatttgccttttggctgggaacgggtattgcctatgagattaatccgcgttggtttttgagcgatacggcaactgaaaatccgaatgcttttgtggcgaaacttgcccgcctgttccgaaatgccgacagggcggttgtcatcgtgaaggaatcgatgaggacggaggaaagtcttgccggagctgtggatgacggtccgttgcagtcggagaaggattatcttgcactcgctgtccggctcagtcgtttgaaagaaaaggcgaaatggtttcacgtaacggagcaggaacatggggaagaggtttggctggattactatatcggcgagggcggtttggttgcggtttcgctttcgcaacgctcgccggaagcgtttgttaatgccgaatatctgtatcggaacgatcgtccgttttctgtaaatgtgtacggcggaacggttcacggggaaaattatgaaacgacaggagaatatcgggttgtttggcaaccggacggttcggtatttgatgcgtcggggcgcgggaaaatcggggaagatgtttatgagcattgcctcgggtgttatcagatggcccaggtatatttggcgaaatatcgggatgtcgcgaatgatgagcagaaggtttgggacttccgcgaagagagtaaccggattgcgtcggactcgcgcgattctgtgttttatcagaatatgcgggaattgatgccccgagggatgaaggcaaacagtcttgtggtcggctatgatgcggacggtctgccgcagaaagtctattggagtttcgacaatgggaaaaaacgccagagtttcgaatattatttgaaaaacggaaatctttttattgcacaatcttcgacggtagcattgaaagcggatggcgtaacggcggatatgcagacctatcatgcgcaacagacgtggtatttagatggcgggcggattgtccgcgaagagaaacagggggacagactgcctgattttcctttgaacttggaagatttggaaaaagaggtgagccgttatgcagaggctgcggcgagacgttcgggcggcaggcgcgacctttctcactga

SEQ ID NO: 2462 - protein, 374 aa, Neisseria meningitidis
MFKKFKPVLLSFFALVFAFWLGTGIAYEINPRWFLSDTATENPNAFVAKLARLFRNADRAVVIVKESMRTEESLAGAVDDGPLQSEKDYLALAVRLSRLKEKAKWFHVTEQEHGEEVWLDYYIGEGGLVAVSLSQRSPEAFVNAEYLYRNDRPFSVNVYGGTVHGENYETTGEYRVVWQPDGSVFDASGRGKIGEDVYEHCLGCYQMAQVYLAKYRDVANDEQKVWDFREESNRIASDSRDSVFYQNMRELMPRGMKANSLVVGYDADGLPQKVYWSFDNGKKRQSFEYYLKNGNLFIAQSSTVALKADGVTADMQTYHAQQTWYLDGGRIVREEKQGDRLPDFPLNLEDLEKEVSRYAEAAARRSGGRRDLSH

SEQ ID NO: 2463 - DNA, 1404 bp, Neisseria gonorrhoeae
atgaatactacattgaaaactaccttgacctctgttgcagcagcctttgcattgtctgcctgcaccatgattcctcaatacgagcagcccaaagtcgaagttgcggaaaccttccaaaacgacacatcggtttcttccatccgcgcggttgatttgggttggcatgactattttgccgacccgcgcctgcaaaagctgatcgacatcgcactcgagcgcaataccagtttgcgtacagccgtattgaacagcgaaatctaccgcaaacaatacatgatcgagcgcaacaacctcctgcccacgcttgccgccaatgcgaacggctcgcgccaaggcagcttgagcggcggcaatgtcagcagcagctacaatgtcggactgggtgcggcatcttacgaactcgatctgttcgggcgcgtgcgcagcaacagcgaagcagcactgcagggctattttgccagcgttgccaaccgcgatgcggcacatttgattctgattgccaccgttgccaaagcctatttcaacgagcgttatgccgaaaaagcgatgtctttggcgcagcgtgtcttgaaaacgcgcgaggaaacctacaagctgtccgaattgcggtacaaggcaggcgtgatttccgccgtcgccctgcgccagcaggaagccttgattgaatctgccaaagccgattatgcccatgccgcgcgcagccgcgaacaggcgcgcaatgccttggcaaccttgattaaccgtccgatacccgaagacctgcccgccggtttgccgttggacaagcagttttttgttgaaaaactgcctgccggtttgagttccgaagtattgctcgaccgtcccgacatccgcgccgccgaacacgcgctcaaacaggcaaacgccaatatcggtgcggcgcgcgccgcctttttcccgtccatccgcctgaccggaagcgtcggtacgggttctgtcgaattgggcgggctgttcaaaagcggcacgggcgtttgggcgttcgctccgtctattaccctgccgatttttacttggggaacgaacaaggcgaaccttgatgtggcaaaactgcgccaacaggcacaaattgttgcctatgaatccgccgtccaatccgcctttcaagacgtggcaaacgcattggcggcgcgcgagcagctggataaagcctatgacgctttaagcaaacaaagccgcgcctctaaagaagcgttgcgcttggtcggactgcgttacaaacacggcgtatccggcgcgctcgatttgctcgatgcggaacgcatcagctattcggcggaaggtgcggctttgtcggcacaactgacccgcgccgaaaaccttgccgatttgtacaaggcgctcgacggcggattgaaacgggatacccaaaccggcaaataa

SEQ ID NO: 2464 - protein, 467 aa, Neisseria gonorrhoeae
MNTTLKTTLTSVAAAFALSACTMIPQYEQPKVEVAETFQNDTSVSSIRAVDLGWHDYFADPRLQKLIDIALERNTSLRTAVLNSEIYRKQYMIERNNLLPTLAANANGSRQGSLSGGNVSSSYNVGLGAASYELDLFGRVRSNSEAALQGYFASVANRDAAHLILIATVAKAYFNERYAEKAMSLAQRVLKTREETYKLSELRYKAGVISAVALRQQEALIESAKADYAHAARSREQARNALATLINRPIPEDLPAGLPLDKQFFVEKLPAGLSSEVLLDRPDIRAAEHALKQANANIGAARAAFFPSIRLTGSVGTGSVELGGLFKSGTGVWAFAPSITLPIFTWGTNKANLDVAKLRQQAQIVAYESAVQSAFQDVANALAAREQLDKAYDALSKQSRASKEALRLVGLRYKHGVSGALDLLDAERISYSAEGAALSAQLTRAENLADLYKALDGGLKRDTQTGK

SEQ ID NO: 2465 - DNA, 1404 bp, Neisseria meningitidis
atggatactacattgaaaaccaccttgacttctgttgcagcagcctttgcattgtctgcctgcaccatgattccccaatacgagcagcccaaagtcgaagttgccgaaacgttcaaaaacgataccgccgacagcggcatccgcgccgtcgatttaggttggcatgactattttgccgacccgcgcctgcaaaagctgatcgacatcgcactcgagcgcaataccagtttgcgtaccgccgtattgaacagcgaaatctaccgcaaacaatacatgattgagcgcaacaacctcctgcccacgcttgccgccaatgcgaacgactcgcgccaaggcagcttgagcggcggcaatgtaagcagcagctacaaagtcggactgggtgcggcatcttacgaactcgatctgttcgggcgtgtacgcagcagcagcgaggcggcactgcaaggctatttcgccagcaccgccaaccgcgatgcggcacatttgagcctgattgccaccgttgccaaagcctatttcaacgaacgttacgccgaagaagcgatgtctttggcgcaacgtgttttgaaaacgcgcgaggaaacctacaagctgtccgaattacgttacaaggcaggcgtgatttccgccgtcgccctacgtcagcaggaagccctgatcgaatctgccaaagccgattatgcccatgccgcgcgcagccgcgaacaggcgcgcaatgccttggcaaccttgattaaccaaccgatacccgaagacctgcctgccggtttgccgctggacaagcagttttttgttgaaaaactgccggccggtttgagttccgaagtattgctcgaccgtcccgatatccgtgctgccgaacacgcgctcaaacaggcaaacgccaatatcggtgcggcacgcgccgcctttttcccatccatccgcctgaccggaaccgtcggtacgggttctgccgaattgggtgggttgttcaaaagcggcacgggcgtttggtcgttcgcgccgtctattaccctgccgatttttacctggggtacgaacaaggcgaaccttgatgtagccaagctgcgccaacaggtacaaatcgttgcctatgaatccgccgtccaatccgcatttcaagacgtggcaaacgcattggcggcgcgcgagcagctggataaagcctatgacgctttaagcaaacaaagccgcgcctctaaagaagcgttgcgcttggtcggcctgcgttacaagcacggcgtatccggcgcgctcgacttgctcgatgcggaacgcagcagctatgcggcggagggtgcggctttgtcggcacaactgacccgcgccgaaaaccttgccgatttgtacaaggcactcggcggcggattgaaacgggatacccaaaccgacaaataa

SEQ ID NO: 2466 - protein, 467 aa, Neisseria meningitidis
MDTTLKTTLTSVAAAFALSACTMIPQYEQPKVEVAETFKNDTADSGIRAVDLGWHDYFADPRLQKLIDIALERNTSLRTAVLNSEIYRKQYMIERNNLLPTLAANANDSRQGSLSGGNVSSSYKVGLGAASYELDLFGRVRSSSEAALQGYFASTANRDAAHLSLIATVAKAYFNERYAEEAMSLAQRVLKTREETYKLSELRYKAGVISAVALRQQEALIESAKADYAHAARSREQARNALATLINQPIPEDLPAGLPLDKQFFVEKLPAGLSSEVLLDRPDIRAAEHALKQANANIGAARAAFFPSIRLTGTVGTGSAELGGLFKSGTGVWSFAPSITLPIFTWGTNKANLDVAKLRQQVQIVAYESAVQSAFQDVANALAAREQLDKAYDALSKQSRASKEALRLVGLRYKHGVSGALDLLDAERSSYAAEGAALSAQLTRAENLADLYKALGGGLKRDTQTDK

SEQ ID NO: 2467 - DNA, 1404 bp, Neisseria meningitidis
atggatactacattgaaaaccaccttgacttctgttgcagcagccttcgcattatccgcctgcaccatgattccccaatacgagcagcccaaagtcgaagttgccgaaacgttcaaaaacgataccgccgacagcggcatccgtgcggtcgatttgggttggcatgactattttgccgacccgcgcctgcaaaagctgatcgacatcgcactcgagcgcaataccagtttgcgtaccgccgtattgaacagcgaaatctaccgcaaacaatacatgattgagcgcaacaacctcctgcccacgcttgccgccaatgcgaacgactcgcgccaaggcagcttgagcggcggcaatgtaagcagcagctacaaagtcggactgggtgcggcatcttacgaactcgatctgttcgggcgtgtacgcagcagcagcgaggcggcactgcaaggctatttcgccagcaccgccaaccgcgatgcggcacatttgagcctgattgccaccgttgccaaagcctatttcaacgaacgttatgccgaagaagcgatgtctttggcgcaacgtgttttgaaaacgcgcgaggaaacctacaagctgtccgaattacgttacaaggcaggcgtgatttccgccgtcgccctacgtcagcaggaagccctaatcgaatctgccaaagccgattatgcccatgccgcgcgcagccgcgaacaggcgcgcaatgccttggcaaccctgattaaccaaccgatacccgacgacctgcccgccggtttgccgttggacaagcagttttttgttgagaagctgccggccggtttgagttccgaagtattgctcgaccgtcccgatatccgtgctgccgaacacgcgctcaaacaggcaaacgccaatatcggtgcggcacgcgccgcctttttcccatccatccgcctgaccggaagcgtcgatacgcattctgccgaattgggcgggctgttcaaaagcggcaccggcgtttggttgttcgcaccttccattaccctgccgatttttacctggggtacgaacaaggcgaacctcgatgtagccaagctgcgccaacaggcacaaatcgttgcctatgaagccgccgtccaatccgcatttcaagacgtggcaaacgcattgaccgcgcgcgagcagttggataaagcctatgacgctttaagcaaacaaagccgcgcctctaaagaagcgttgcgtttggtcggtctgcgttacaaacacggcgtatccggcgcgctcgacttgctcgatgcggaacgcagcagctattcggcggaaggtgcggctttgtcggcacaactgacccgcgccgaaaaccttgccgatttgtacaaggcactcggcggcggattgaaacgggatacccaaaccgacaaataa

SEQ ID NO: 2468 - protein, 467 aa, Neisseria meningitidis
MDTTLKTTLTSVAAAFALSACTMIPQYEQPKVEVAETFKNDTADSGIRAVDLGWHDYFADPRLQKLIDIALERNTSLRTAVLNSEIYRKQYMIERNNLLPTLAANANDSRQGSLSGGNVSSSYKVGLGAASYELDLFGRVRSSSEAALQGYFASTANRDAAHLSLIATVAKAYFNERYAEEAMSLAQRVLKTREETYKLSELRYKAGVISAVALRQQEALIESAKADYAHAARSREQARNALATLINQPIPDDLPAGLPLDKQFFVEKLPAGLSSEVLLDRPDIRAAEHALKQANANIGAARAAFFPSIRLTGSVDTHSAELGGLFKSGTGVWLFAPSITLPIFTWGTNKANLDVAKLRQQAQIVAYEAAVQSAFQDVANALTAREQLDKAYDALSKQSRASKEALRLVGLRYKHGVSGALDLLDAERSSYSAEGAALSAQLTRAENLADLYKALGGGLKRDTQTDK

SEQ ID NO: 2469 - DNA, 1731 bp, Neisseria gonorrhoeae
gtgaaaccgctgcgcagactgacaaacctccttgccgcctgcgccgtagcggcggtcgcactcatacagcccgccctcgcggcggacttggcgcaagacccgttcattaccgataacacccaacggcagcactacgaacccggcggcaaataccacctcttcggcgacccgcgcggcagcgtttccgaccgcaccggcaaaatcaacgtcatccaagactatacccaccagatgggcaacctgctcatccaacaggcggcaatccaaggcaatcttggttacaccgtccgcttttccggacacggacacgaagaacacgcccccttcgacaaccacgccgccgacagcgcaagcgaagaaaaaggcaacgttgacgacggctttaccgtgtaccggctcaactgggaaggacacgaacatcatcccgccgatgcctacgacggcccgaagggcggcaattaccccaaacctacgggcgcacgagacgaatacacctatcacgtcaacggcacagcccgcagtatcaaactcaatccgaccgacacccgcagcatccggcaacgcatattcgacaactacaacaacctcggcagcaatttctccgaccgcgccgatgaagccaacagaaaaatgttcgagcacaatgccaagctcgaccgctggggcaacagcatggagtttgtcaacggcgtcgccgccggcgcgctcaacccctttatcagcgcgggcgaagccttgggcataggcgacatactgtacggaacgcgctatgccatagacaaagccgcgatgcgcaacatcgcccccttacccgccgagggcaaattcgccgccatcggcggcttgggcagcgcggcgggctttgaaaaaaatacgcgcgaagccgttgaccggtggatacaggaaaaccccaatgccgccgaaaccgtcgaagccctggtcaacgtcctgccgtttgccaaagtcaaaaacctgacaaaggcggcaaaaccggggaaggctgcggttagtggggatttttctaaatcctacacctgctccttccacggcagcaccttggtcaaaacggcagacggctacaaagccattgcccatattcaagccggagaccgcgtcctttccaaggacgaggcaagcggagaaacgggatacaaacccgttaccgcccgatacggcaatccgtatcaagaaaccgtttacattgaagtttcagacggcatcggcaacagccaaaccctgatttccaaccgcatccacccgttttattcggacggcaaatggattaaggcggaagatttaaaagcgggaagccggctgttatccgaaagcggcaaaacccaaaccgtccgcaacatcgttgtcaaaccaaaaccgctcaaagcctacaatctgaccgttgccgattggcatacctacttcgtcaagggtaatcaggcggaaacggaaggggtttgggttcataatgattgtccgcctaaaccaaaaccaaccaatcatgcccaacaaagaaaagaagaagctaaaaacgattctcatcgaagtgtgggagattccaatcgtgtcgttcgcgaaggaaagcaatatttagattccgacacaggaaaccatgtttatgtaaaaggagataaagtggttattctaactcctgatggaagacaggtaactcaatttaagaactcgaaagccaatacgtcaaaaagggtaaaaaatgggaaatggacaccaaaataa

SEQ ID NO: 2470 - protein, 576 aa, Neisseria gonorrhoeae
VKPLRRLTNLLAACAVAAVALIQPALAADLAQDPFITDNTQRQHYEPGGKYHLFGDPRGSVSDRTGKINVIQDYTHQMGNLLIQQAAIQGNLGYTVRFSGHGHEEHAPFDNHAADSASEEKGNVDDGFTVYRLNWEGHEHHPADAYDGPKGGNYPKPTGARDEYTYHVNGTARSIKLNPTDTRSIRQRIFDNYNNLGSNFSDRADEANRKMFEHNAKLDRWGNSMEFVNGVAAGALNPFISAGEALGIGDILYGTRYAIDKAAMRNIAPLPAEGKFAAIGGLGSAAGFEKNTREAVDRWIQENPNAAETVEALVNVLPFAKVKNLTKAAKPGKAAVSGDFSKSYTCSFHGSTLVKTADGYKAIAHIQAGDRVLSKDEASGETGYKPVTARYGNPYQETVYIEVSDGIGNSQTLISNRIHPFYSDGKWIKAEDLKAGSRLLSESGKTQTVRNIVVKPKPLKAYNLTVADWHTYFVKGNQAETEGVWVHNDCPPKPKPTNHAQQRKEEAKNDSHRSVGDSNRVVREGKQYLDSDTGNHVYVKGDKVVILTPDGRQVTQFKNSKANTSKRVKNGKWTPK

SEQ ID NO: 2471 - DNA, 1404 bp, Neisseria meningitidis
gtgaaaccgctgcgcagactgacaaacctccttgccgcctgcgccgtagcggcggccgcactcatacagcccgccctcgcggcggacttggcgcaagacccgttcattaccgataacgcccaacggcagcactacgaacccggcggcaaataccacctcttcggcgacccgcgcggcagcgtttccgaccgcaccggcaaaatcaacgtcatccaagactatacccaccagatgggcaacctgctcatccaacaggcaaacatcaacggcacaatcggctaccacacccgcttttccggacacggacacgaagaacacgcccccttcgacaaccacgccgccgacagcgcgagcgaagaaaaaggcaacgttgacgaaggctttaccgtataccggctcaactgggaaggacacgaacatcatcccgccgatgcctacgacggcccgaagggcggcaattaccccaaacctacgggcgcacgagacgaatacacctatcacgtcaacggcacagcccgcagtatcaaactcaatccgaccgacacccgcagcatccggcaacgcatatccgacaattacagcaacctcggcagcaatttctccgaccgcgccgatgaagccaacagaaaaatgttcgagcacaatgccaagctcgaccgctggggcaacagcatggagtttatcaacggcgtcgccgccggcgcgctcaacccctttatcagcgcgggcgaagccttgggcataggcgacatactgtacggaacgcgctatgccatagacaaagccgcaatgcgcaacatcgcccccttgcccgccgagggcaaattcgccgtcatcggcggcttgggcagcgtggcgggctttgaaaagaatacgcgcgaagccgttgaccggtggatacaggaaaatcccaatgccgccgaaaccgtcgaagccgtcttcaacgttgccgcagcagccaaagtcgcgaagttggcaaaggcggcaaaaccagggaaggctgcggttagcggggattttgctgattcttataaaaagaaattggctttgtctgatagtgcgagacagttatatcaaaatgcaaagtatagagaagctctagatatacattatgaagatttaattagaagaaaaactgatggttcatcaaaatttattaacggcagagaaattgacgctgttacgaatgatgctttaatacaagccaaaagaacaatttcagcaatagataaacctaaaaatttcttaaatcaaaaaaatagaaagcaaattaaagcaaccatcgaagcagcaaaccaacagggaaaacgtgcagaattttggtttaaatacggtgttcattcacaagttaagtcatatattgaatcaaaaggcggcattgttaaaacaggtttaggagattaa

SEQ ID NO: 2472 - protein, 467 aa, Neisseria meningitidis
VKPLRRLTNLLAACAVAAAALIQPALAADLAQDPFITDNAQRQHYEPGGKYHLFGDPRGSVSDRTGKINVIQDYTHQMGNLLIQQANINGTIGYHTRFSGHGHEEHAPFDNHAADSASEEKGNVDEGFTVYRLNWEGHEHHPADAYDGPKGGNYPKPTGARDEYTYHVNGTARSIKLNPTDTRSIRQRISDNYSNLGSNFSDRADEANRKMFEHNAKLDRWGNSMEFINGVAAGALNPFISAGEALGIGDILYGTRYAIDKAAMRNIAPLPAEGKFAVIGGLGSVAGFEKNTREAVDRWIQENPNAAETVEAVFNVAAAAKVAKLAKAAKPGKAAVSGDFADSYKKKLALSDSARQLYQNAKYREALDIHYEDLIRRKTDGSSKFINGREIDAVTNDALIQAKRTISAIDKPKNFLNQKNRKQIKATIEAANQQGKRAEFWFKYGVHSQVKSYIESKGGIVKTGLGD

SEQ ID NO: 2473 - DNA, 1497 bp, Neisseria meningitidis
gtgaaaccgctgcgaagactcatcaagctccttgccgcctgtgccgtagcggcggccgcactcatacagcccgccctcgcggcggacttggcgcaagacccgttcattaccgataacgcccaacggcagcactacgaacccggaggcaaataccacctcttcggcgacccgcgcggcagcgtctccgaccgcaccggtcaaatcaacgtcatccaagactatacccaccggatgggcaacctgctcatccagcaggcaaacatcaacggcacaatcggctaccacacccgcttttccggacacggatacgaagaacacgcccccttcgacaaccacgccgccgacagcgcgagcgaagaaaaaggcaacgttgacgaaggctttaccgtataccggctcaactgggaaggacacgaacatcatcccgccgatgcctacgacggcccgaagggcggcaattaccccaaacctacgggtgcacgcgacgaatacacctatcacgtcaacggcacagcacgcagcatcaaactcaatccgaccgacacccgcagcatccggcaacgcatatccgacaattacagcaacctcggcagcaatttctccgaccgcgccgatgaagccaacagaaaaatgttcgagcacaatgccaagctcgaccgctggggcaacagcatggagtttatcaacggcgtcgccgccggcgcgctcaacccctttatcagcgcgggcgaagccttgggcataggcgacatactgtacggaacgcgctatgccatagacaaagccgcaatgcgcaacatcgcccccttgcccgccgagggcaaattcgccgtcatcggcggcttgggcagcgtggcgggctttgaaaaaaatacgcgcgaagccgttgaccggtggatacaggaaaaccccaatgccgccgaaaccgtcgaagccctggtcaacgtcctgccgtttgccaaagtcaaaaacctgacaaaggcggcaaaaccggggaaggctgcggttagcggggatttttctgctgcatacaatacaagaacaactagaaaagttactacagaaacagaggggttaaatagaatcagacagaaccagaaaaatagtaatatacatgagaaaaattatggaagagataatcctaatcatattaatgttttatctggaaattctatacaacatatactgtatggagatgaagcaggaggtgggcatctttttcctggcaaacctggtaagacaacattcccccaacattggtcagccagtaaaataactcatgaaattagtgatatcgttacatccccaaaaacgcaatggtatgcacagactggaacaggcggcaaatatattgctaaaggaagaccagctaggtgggtatcatatgaaacgagagatggaattcgtatcagaacagtttatgaacctgcaacaggaaaagtggtaactgcattccccgatagaacctctaatcccaaatataaccctgtaaaataa

SEQ ID NO: 2474 - protein, 498 aa, Neisseria meningitidis
VKPLRRLIKLLAACAVAAAALIQPALAADLAQDPFITDNAQRQHYEPGGKYHLFGDPRGSVSDRTGQINVIQDYTHRMGNLLIQQANINGTIGYHTRFSGHGYEEHAPFDNHAADSASEEKGNVDEGFTVYRLNWEGHEHHPADAYDGPKGGNYPKPTGARDEYTYHVNGTARSIKLNPTDTRSIRQRISDNYSNLGSNFSDRADEANRKMFEHNAKLDRWGNSMEFINGVAAGALNPFISAGEALGIGDILYGTRYAIDKAAMRNIAPLPAEGKFAVIGGLGSVAGFEKNTREAVDRWIQENPNAAETVEALVNVLPFAKVKNLTKAAKPGKAAVSGDFSAAYNTRTTRKVTTETEGLNRIRQNQKNSNIHEKNYGRDNPNHINVLSGNSIQHILYGDEAGGGHLFPGKPGKTTFPQHWSASKITHEISDIVTSPKTQWYAQTGTGGKYIAKGRPARWVSYETRDGIRIRTVYEPATGKVVTAFPDRTSNPKYNPVK

SEQ ID NO: 2475 - DNA, 255 bp, Neisseria gonorrhoeae
gattttcgagcgttttcatgcgagaacggtttgtctgtgcgcgtccgcaatttggacggcggcaaaatcgcgttgcggctggacggcaggcgtgccgtcctctcttccgacgttgccgcatccggcgaacgctataccgccgaacacggtttgttcggaaacggaaccgagtggcaccagaaaggcggcgaagcctttttcggctttaccgatgcctacggcaattcggtcgaaacttcctgccgcgcccgttaa

SEQ ID NO: 2476 - protein, 84 aa, Neisseria gonorrhoeae
DFRAFSCENGLSVRVRNLDGGKIALRLDGRRAVLSSDVAASGERYTAEHGLFGNGTEWHQKGGEAFFGFTDAYGNSVETSCRAR

SEQ ID NO: 2477 - DNA, 381 bp, Neisseria meningitidis
atgaatatcaggtttttcgcgctgaccgtaccggttttgtctttggcggcctgtgccgtgccggaggcgtatgatgacggcggacgcgggcatatgccgcccgttcaaaaccaagccggcacggacgattttcgggcgttttcctgcgagaacggtttgtctgtgcgcgtccgccatttggacagcggcaaagtcgcgttgcggctggacggcaggcgtgccgtcctctcttccgacgttgccgcatccggcgaacgctataccgccgaacacggtttgttcggaaacgcaaccgagtggcaccagaaaggcggcgaagcctttttcggctttaccgatgcctacggcaattcggtcgaaacttcctgccgcgcccgttaa

SEQ ID NO: 2478 - protein, 126 aa, Neisseria meningitidis
MNIRFFALTVPVLSLAACAVPEAYDDGGRGHMPPVQNQAGTDDFRAFSCENGLSVRVRHLDSGKVALRLDGRRAVLSSDVAASGERYTAEHGLFGNATEWHQKGGEAFFGFTDAYGNSVETSCRAR

SEQ ID NO: 2479 - DNA, 381 bp, Neisseria meningitidis
atgaatatcaggtttttcgcgctgaccgtaccggttttgtctttggcggcctgtgccgtgccggaggcgtatgatgacggcggacgagggcatatgccgcccgttcaaaaccaagccggcacggcagattttcgggcattttcctgcgagaacggtttgtctgtgcacgtccgccgtttggacggcggcagaatcgcgttgcggttggacggcaggcgtgccgtcctctcttccgacgttgccgcatccggcgaacgctataccgccgaacacggtttgttcggaaacggaaccgagtggcatcagaaaggcggcgaagcctttttcggctttaccgatgcctacggcaattcggtcgaaacctcctgccgcgcccgctaa

SEQ ID NO: 2480 - protein, 126 aa, Neisseria meningitidis
MNIRFFALTVPVLSLAACAVPEAYDDGGRGHMPPVQNQAGTADFRAFSCENGLSVHVRRLDGGRIALRLDGRRAVLSSDVAASGERYTAEHGLFGNGTEWHQKGGEAFFGFTDAYGNSVETSCRAR

SEQ ID NO: 2481 - DNA, 1476 bp, Neisseria gonorrhoeae
atgtcgaaacctgtttttaagaaaatcgcactttatactttgggtgcaatcagcggcgtggccgtaagtctggcggtgcagggttttgccgccgagaaggacgggcgggataacgaagtcctgccggtgcaatccatccgtacgatggcggaggtttacggtcagattaaggcaaactactatcatgacaaacccgatgccgatttgtttgaaggtgcgatgaagggtatggtggccggtttggatccgcattccgaatatatggataaaaaaggttatgccgagataaaggagtccaccagcggcgaatttggcggcttggggatggaaatcgggcaggaagacggttttgtcaaagtggtttcgccgattgaggacacgcctgccgaacgggcggaggtgaaaagcggcgatttcattgtgaaaatcgataatgtttcgacgcgcggtatgacggtcagcgaagcggtgaaaaaaatgcggggcaagccgggtacgaagattactttgacgttgtcgcgcaaaaatgccgacaagccgatagtcgtcaacctgacccgtgccattattaaagtgaaaagcgtccgccatcacctgatcgaacccgattacggctatatccgcgtgtcgcagttccaagagcggacggtcgaaagcgtcaataccgccgcaaaagagctggtaaaggaaaataaaggaaaaccgctcaaggggctggtgttggatttgcgcgacgaccccggcgggcttttgaccggcgcggtcggcgtgtcggcggcgtttctgccgtctgaagcggtcgtcgtcagcaccaagggacgcgacggcaaagacggcatggtactgaaagccgttcccgaggattatgtgtacggtatgggcggcgaccctttggcgggtattcctgccgagttgaaaacgattccgatgacggtattggtcaattccggttcggcttccgcgtcggagattgtcgccggcgcattgcaggaccacaaacgcgcggtcatcgtcggtacgcagagcttcggtaaaggttcggttcagactttgattcctttgtccaacggcagcgcggtcaagttgacgaccgccctgtattacacgccgaacgaccgttccattcaggcacaggggattgttcccgatgtcgaagtaaaagataaggaacgtacttttgaaagccgcgaggcggacctggtcggacacatcggcaatcccttgggcggcgaggatgtgaacagtgaaacccttgccgtaccgcttgaaaaagatgcggataagcccgctgcaaaagaaaaaggtaaaaagaaaaaggacgaggatttgtcttcaaggcggattccgaaccctgcgaaagacgatcagttgcgtaaggctttggatttggtcaagtcgcccgagcagtggcagaagtctttggggctggcggcgaaaaaaccggtttcaaataaagataaaaaagataagaagtag

SEQ ID NO: 2482 - protein, 491 aa, Neisseria gonorrhoeae
MSKPVFKKIALYTLGAISGVAVSLAVQGFAAEKDGRDNEVLPVQSIRTMAEVYGQIKANYYHDKPDADLFEGAMKGMVAGLDPHSEYMDKKGYAEIKESTSGEFGGLGMEIGQEDGFVKVVSPIEDTPAERAEVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDGMVLKAVPEDYVYGMGGDPLAGIPAELKTIPMTVLVNSGSASASEIVAGALQDHKRAVIVGTQSFGKGSVQTLIPLSNGSAVKLTTALYYTPNDRSIQAQGIVPDVEVKDKERTFESREADLVGHIGNPLGGEDVNSETLAVPLEKDADKPAAKEKGKKKKDEDLSSRRIPNPAKDDQLRKALDLVKSPEQWQKSLGLAAKKPVSNKDKKDKK

SEQ ID NO: 2483 - DNA, 1485 bp, Neisseria meningitidis
atgtcgaaacctgtttttaagaaaatcgcactttatactttgggtgcaatcagcggcgtggccgtcagtctggcggtgcagggttttgccgccgagaaggacaggcgggataacgaagtcctgccggtgcaatccatccgcacaatggcggaggtttacggtcaaatcaaggcaaactactatcaggacaaacccgatgccgatttgtttgaaggtgcgatgaagggtatggtggccggtttggatccgcattccgaatatatggataaaaaaggttatgccgagataaaggagtccaccagcggcgaatttggcggcttggggatggaaatcgggcaggaagacggatttgtcaaagtggtttcgccgattgaggacacgcctgcggaacgggcgggggtgaaaagcggcgatttcattgtgaaaatcgataatgtttcgacacgcggcatgacggtcagcgaagcggtgaagaaaatgcggggcaagccgggtacgaagattactttgacgctgtcgcgcaaaaatgccgacaagccgatagtcgtcaacctgacccgtgccattattaaagtgaaaagcgtccgccatcacctgatcgaacccgattacggctatatccgcgtgtcgcagttccaagagcggacggtcgaaagcgtcaataccgccgcaaaagagctggtaaaggaaaataaaggaaaaccgctcaaggggctggtgttggatttgcgcgacgaccccggcgggcttttgactggcgcggtcggcgtgtcggcggcatttctgccgtctgaagcagtcgtcgtcagcaccaagggacgcgacggcaaagaccgcatggtactgaaagccattcctgaagattatgtgtacgggatgggcggcgattcgttggcgggcattcctgccgagttgaaaaccataccgatgacggtattggtcaattccggttcggcttccgcgtcggagattgtcgcaggtgcattgcaggatcataaacgcgcggtcatcgtcggtacgcagagcttcggcaaaggttcggttcagactttgattcctttgtccaacggcagcgcggtcaagctgacaacggcactgtattatacgccgaacgaccgttctattcaggcgcaggggattgttcccgatgtcgaagtaaaagataaggaacgcatttttgaaagccgcgaggcggatttggtcggacacatcggcaatcccttgggcggcgaggatgtgaacggtgaaacccttgccgtgccgcttgaaaaagatgcggataagcccgctgtaaaagaaaaaggtaaaaagaaaaaggacgaggatttgtcttcaaggcggattcccaaccctgccaaagacgaccagttgcggaaagctttggatttagtcaagtcgcccgagcagtggcagaagtctttggggctggcggcgaaaaagccggtttcaaataaagataagaaagataaaaaagataagaagtag

SEQ ID NO: 2484 - protein, 494 aa, Neisseria meningitidis
MSKPVFKKIALYTLGAISGVAVSLAVQGFAAEKDRRDNEVLPVQSIRTMAEVYGQIKANYYQDKPDADLFEGAMKGMVAGLDPHSEYMDKKGYAEIKESTSGEFGGLGMEIGQEDGFVKVVSPIEDTPAERAGVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDRMVLKAIPEDYVYGMGGDSLAGIPAELKTIPMTVLVNSGSASASEIVAGALQDHKRAVIVGTQSFGKGSVQTLIPLSNGSAVKLTTALYYTPNDRSIQAQGIVPDVEVKDKERIFESREADLVGHIGNPLGGEDVNGETLAVPLEKDADKPAVKEKGKKKKDEDLSSRRIPNPAKDDQLRKALDLVKSPEQWQKSLGLAAKKPVSNKDKKDKKDKK

SEQ ID NO: 2485 - DNA, 1485 bp, Neisseria meningitidis
atgtcgaaacctgtttttaagaaaatcgcactttatactttgggtgcaatcagcggcgtggccgtcagtctggcggtgcagggttttgccgccgagaaggacaggcgggataacgaagtcctgccggtgcaatccatccgcacaatggcggaggtttacggtcaaatcaaggcaaactactatcaggacaaacccgatgccgatttgtttgaaggtgcgatgaagggtatggtggccggtttggatccgcattccgaatatatggataaaaaaggttatgccgagataaaggagtccaccagcggcgaatttggcggcttggggatggaaatcgggcaggaagacggatttgtcaaagtggtttcgccgattgaggacacgcctgcggaacgggcgggggtgaaaagcggcgatttcattgtgaaaatcgataatgtttcgacacgcggcatgacggtcagcgaagcggtgaagaaaatgcggggcaagccgggtacgaagattactttgacgctgtcgcgcaaaaatgccgacaagccgatagtcgtcaacctgacccgtgccattattaaagtgaaaagcgtccgccatcacctgatcgaacccgattacggctatatccgcgtgtcgcagttccaagagcggacggtcgaaagcgtcaataccgccgcaaaagagctggtaaaggaaaataaaggaaaaccgctcaaggggctggtgttggatttgcgcgacgaccccggcgggcttttgactggcgcggtcggcgtgtcggcggcatttctgccgtctgaagcagtcgtcgtcagcaccaagggacgcgacggcaaagaccgcatggtactgaaagccgttcctgaagattatgtgtacgggatgggcggcgattcgttggcgggcattcctgccgagttgaaaaccataccgatgacggtattggtcaattccggttcggcttccgcgtcggagattgtcgcaggtgcattgcaggatcataaacgcgcggtcatcgtcggtacgcagagcttcggcaaaggttcggttcagactttgattcctttgtccaacggcagcgcggtcaagctgacaacggcactgtattatacgccgaacgaccgttctattcaggcgcaggggattgttcccgatgtcgaagtaaaagataaggaacgcatttttgaaagccgcgaggcggatttggtcggacacatcggcaatcctttgggcggcgaggatgtgaacagtgaaacccttgccgtgccgcttgaaaaagatgcggataagcccgctgtaaaagaaaaaggtaaaaagaaaaaggacgaggatttgtcttcaaggcggattcccaaccctgccaaagacgaccagttgcggaaagctttggatttagtcaagtcgcccgagcagtggcagaagtctttggggctggcggcgaaaaagccggtttcaaataaagataagaaagataaaaaagataagaagtag

SEQ ID NO: 2486 - protein, 494 aa, Neisseria meningitidis
MSKPVFKKIALYTLGAISGVAVSLAVQGFAAEKDRRDNEVLPVQSIRTMAEVYGQIKANYYQDKPDADLFEGAMKGMVAGLDPHSEYMDKKGYAEIKESTSGEFGGLGMEIGQEDGFVKVVSPIEDTPAERAGVKSGDFIVKIDNVSTRGMTVSEAVKKMRGKPGTKITLTLSRKNADKPIVVNLTRAIIKVKSVRHHLIEPDYGYIRVSQFQERTVESVNTAAKELVKENKGKPLKGLVLDLRDDPGGLLTGAVGVSAAFLPSEAVVVSTKGRDGKDRMVLKAVPEDYVYGMGGDSLAGIPAELKTIPMTVLVNSGSASASEIVAGALQDHKRAVIVGTQSFGKGSVQTLIPLSNGSAVKLTTALYYTPNDRSIQAQGIVPDVEVKDKERIFESREADLVGHIGNPLGGEDVNSETLAVPLEKDADKPAVKEKGKKKKDEDLSSRRIPNPAKDDQLRKALDLVKSPEQWQKSLGLAAKKPVSNKDKKDKKDKK

SEQ ID NO: 2487 - DNA, 372 bp, Neisseria gonorrhoeae
atgatgaatccgaaaaccttgggccgtttgtcgctgtgtgcggcggtcttggctctgaccgcctgcgccggcggcgggcataaaaacctgtattattacggcggttatcccgataccgtctatgaaggtttgaaaaacgacgacacttcgttgggcaagcagaccgaaaagatggaaaaatactttgcggaagccgccaacaaaaaaatgaatgccgccccgggtgcgcacgcccatttgggactgctgctttcccgttcgggagacaaagagggcgcgttccgccaatttgaagaagagaaaaggctgtttcccgaatcgggcgtatttatggacttcctgatgaaaaccggtaaaggaggcaagcgatga

SEQ ID NO: 2488 - protein, 123 aa, Neisseria gonorrhoeae
MMNPKTLGRLSLCAAVLALTACAGGGHKNLYYYGGYPDTVYEGLKNDDTSLGKQTEKMEKYFAEAANKKMNAAPGAHAHLGLLLSRSGDKEGAFRQFEEEKRLFPESGVFMDFLMKTGKGGKR

SEQ ID NO: 2489 - DNA, 372 bp, Neisseria meningitidis
atgatgaatccgaaaaccttgagccgtttgtcgctgtgtgcggcggtcttggctctgaccgcctgcggcggcaacgggcaaaaatccctgtattattacggcggctatcccgataccgtctatgaaggtttgaaaaacgacgacacttcgttgggcaagcagaccgaaaagatggaaaaatactttgtggaagccggcaacaaaaaaatgaatgccgccccgggtgcgcacgcccatctgggactgctgctttcccgttcgggagacaaagagggcgcgttccgccagtttgaagaagagaaaaggctgtttcccgaatcgggcgtatttatggacttcctgatgaaaaccggtaaaggaggcaagcgatga

SEQ ID NO: 2490 - protein, 123 aa, Neisseria meningitidis
MMNPKTLSRLSLCAAVLALTACGGNGQKSLYYYGGYPDTVYEGLKNDDTSLGKQTEKMEKYFVEAGNKKMNAAPGAHAHLGLLLSRSGDKEGAFRQFEEEKRLFPESGVFMDFLMKTGKGGKR

SEQ ID NO: 2491 - DNA, 372 bp, Neisseria meningitidis; identical to SEQ ID NO: 2489

SEQ ID NO: 2492 - protein, 123 aa, Neisseria meningitidis; identical to SEQ ID NO: 2490

SEQ ID NO: 2493 - DNA, 483 bp, Neisseria gonorrhoeae
atgatgaaaaagatactggcagtatcggcactatgcctgatgactgcggcggcacaggctgccgatacttacggctatctcgccgtttggcagaatccgcaggatgcaaacgatgttttgcaggttaaaaccacaaaagaagattcggcgaaaagcgaagcgtttgccgagttggaagccttttgcaaaggtcaggacacgcttgcgggcattgccgaagacgagccgaccggatgccggtcggtcgtgtcgctgaacaatacctgtgtctcgctggcatacccgaaagccttgggcgcgatgcgcgttgaaaacgccgtcgtgattacttctccgcgttttacgagcgttcatcaggtcgcactcaaccagtgcataaaaaaatacggcgcacagggacaatgcggcttggaaacagtgtattgcacgtcatcttcttattacggcggggctgttcgctccttaatccaacacctgaaataa

SEQ ID NO: 2494 - protein, 160 aa, Neisseria gonorrhoeae
MMKKILAVSALCLMTAAAQAADTYGYLAVWQNPQDANDVLQVKTTKEDSAKSEAFAELEAFCKGQDTLAGIAEDEPTGCRSVVSLNNTCVSLAYPKALGAMRVENAVVITSPRFTSVHQVALNQCIKKYGAQGQCGLETVYCTSSSYYGGAVRSLIQHLK

SEQ ID NO: 2495 - DNA, 279 bp, Neisseria meningitidis
tcgggcattgctgaagacgagccgaccggatgccggtcggtcgtgtcgctgaacaatacctgtgtcgcgctggcatacccgaaagccttgggcgcgctgcgtgtcgacaacgccgtcgtgattacttctccgcgttttacgagcgttcatcaggtcgcactcaaccagtgcatcaaaaaatacggcgtacagggacaatgcggcttggaaacagtgtattgcacatcttcttcttattacggcggaactgtgcgctctttgattcaaaatctcaaataa

SEQ ID NO: 2496 - protein, 92 aa, Neisseria meningitidis
SGIAEDEPTGCRSVVSLNNTCVALAYPKALGALRVDNAVVITSPRFTSVHQVALNQCIKKYGVQGQCGLETVYCTSSSYYGGTVRSLIQNLK

SEQ ID NO: 2497 - DNA, 483 bp, Neisseria meningitidis
atgatgaaaaagatactggccgtatcggcactatgcctgatgactgcggcggcacgggctgccgatacttacggctatctcgccgtttggcagaatccgcagaatgcaaacgatgttttgcaggttaaaaccacaaaagaagattcgacgaaaagcgaagcgtttgccgagttggaagctttctgcaaaggtcaggacacgcttgcgggcattgccgaagacgagccgaccggatgccggtcggtcgtgtcgctgaacaatacctgtgtcgcgctggcatacccgaaagccttgggcgcgatgcgcgttgaaaacgccgttgtgattacttctccgcgttttacgagcgtttatcaggtcgcactcaaccagtgcatcaaaaaatacggcgcacagggacaatgcggcttggaaacagtgtattgcacgtcttcttcttattacgggggaactgtgcgctctttgattcaaaatctcaaataa

SEQ ID NO: 2498 - protein, 160 aa, Neisseria meningitidis
MMKKILAVSALCLMTAAARAADTYGYLAVWQNPQNANDVLQVKTTKEDSTKSEAFAELEAFCKGQDTLAGIAEDEPTGCRSVVSLNNTCVALAYPKALGAMRVENAVVITSPRFTSVYQVALNQCIKKYGAQGQCGLETVYCTSSSYYGGTVRSLIQNLK

SEQ ID NO: 2499 - DNA, 420 bp, Neisseria meningitidis
atgaatctcgtgaaactgctggcgaataactggcaaccgattgccattatcgcgcttgtcggcacgggcttggctgtgtcgcaccatcaaggctacaagtcggcatttgcgaagcagcaggcggtcatcgacaagatggagcgcgacaaggcgcaagccctgctgttgtcggctcaaaactatgcgcgcgaactggaactggcacgcgcggaagctaaaaaatatgaagtcaaggcgcacgctgtcggcatggctttggcgaaaaaacaggcggaagtcagccgtctgaaaacggaaaataaaaaggaaatcgaaaatgtccttactcaagaccgtaaaaatgcaagcggcggttgcattgacggctttggctctcacggcctgcagctctacaaccgcgccctcggctacggaaattaa

SEQ ID NO: 2500 - protein, 139 aa, Neisseria meningitidis
MNLVKLLANNWQPIAIIALVGTGLAVSHHQGYKSAFAKQQAVIDKMERDKAQALLLSAQNYARELELARAEAKKYEVKAHAVGMALAKKQAEVSRLKTENKKEIENVLTQDRKNASGGCIDGFGSHGLQLYNRALGYGN

SEQ ID NO: 2501 - DNA, 420 bp, Neisseria meningitidis; identical to SEQ ID NO: 2455

SEQ ID NO: 2502 - protein, 139 aa, Neisseria meningitidis; identical to SEQ ID NO: 2456

SEQ ID NO: 2503 - DNA, 777 bp, Neisseria gonorrhoeae
atgaattttatccgttccgtcggggcgaaaaccctcggccttattcaatccttcggcagtatcacgctgtttctgctgaacattttggcgaaatccggcacggctttcgcccgtccgcgcctgagcgtgcgccaagtgtattttgccggcgtgctgtcggtgctgattgttgccgtttcggggctgttcgtcggtatggttttgggtttgcagggctatacgcagttgtcgaaattcaaatccgccgatattttgggctatatggtcgcggcttctctgttgcgcgaactgggtcccgtgttggcggcgattctgtttgccagcagcgcgggcggtgcgatgaccagcgaaatcggtttgatgaaaacgaccggacagctcgaagcgatgaacgtgatggcggtcaaccccgtcgcccgcgtggttgccccgcgtttttgggcgggcgtgttttctatgccgcttttggcttcgattttcaacgtcgcgggcattttcggcgcgtatttggtcggcgtgagctggctgggtttggacagcggtattttctggccgcagatgcagaacaacattacgatacattacgatgtaatcaacggtttgatcaaatccgccgcgttcggcgtggcggtaacgctgattgccgtgcatcagggcttccactgcatcccgacttcggaaggcattttgcgcgccagcacgcgcacggtggtttcgtccgccctgacgattttggcggtcgattttatattgaccgcgtggatgtttacagattga

SEQ ID NO: 2504 - protein, 258 aa, Neisseria gonorrhoeae
MNFIRSVGAKTLGLIQSFGSITLFLLNILAKSGTAFARPRLSVRQVYFAGVLSVLIVAVSGLFVGMVLGLQGYTQLSKFKSADILGYMVAASLLRELGPVLAAILFASSAGGAMTSEIGLMKTTGQLEAMNVMAVNPVARVVAPRFWAGVFSMPLLASIFNVAGIFGAYLVGVSWLGLDSGIFWPQMQNNITIHYDVINGLIKSAAFGVAVTLIAVHQGFHCIPTSEGILRASTRTVVSSALTILAVDFILTAWMFTD

SEQ ID NO: 2505 - DNA, 777 bp, Neisseria meningitidis; identical to SEQ ID NO: 2503

SEQ ID NO: 2506 - protein, 258 aa, Neisseria meningitidis
MNFIRSVGAKTLGLIQSLGSITLFLLNILAKSGTAFVRPRLSVRQVYFAGVLSVLIVAVSGLFVGMVLGLQGYTQLSKFKSADILGYMVAASLLRELGPVLAAILFASSAGGAMTSEIGLMKTTEQLEAMNVMAVNPVARVVAPRFWAGVFSMPLLASIFNVAGIFGAYLVGVTWLGLDSGIFWSQMQNNITIHYDVINGLIKSAAFGVAVTLIAVHQGFHCVPTSEGILRASTRTVVSSALTILAVDFILTAWMFTD

SEQ ID NO: 2507 - DNA, 777 bp, Neisseria meningitidis
atgaattttatccgttccgtcggggcgaaaaccctcggccttattcaatctctcggcagtatcacgctgtttctgctgaatattctggcgaaatccggtacggctttcgtccgtccgcgcctgagcgtgcgccaagtgtattttgccggcgtgctgtcggtgttgattgttgccgtttcagggctgtttgtcggcatggtcttgggtttgcagggctatacgcagttgtcgaaattcaaatccgccgatattttgggctatatggtcgcggcttcgctgttgcgcgaactgggtccggtgttggcggcgattctgtttgccagcagcgcgggcggtgcgatgaccagcgaaatcggtttgatgaaaacgaccgaacagctcgaagcgatgaacgtgatggcggtaaaccccgtcgcccgagtggttgcgccgcgcttttgggcgggcgtgttttccatgccgcttttggcttcgattttcaacgtggcgggtattttcggcgcgtatttggtcggtgtaacctggctgggcttggacagcggtattttctggtcgcaaatgcagaacaacatcacgatacattacgatgtaatcaacggtctgatcaaatccgccgcgttcggcgtggcggtaacgctgattgccgtgcatcagggcttccactgcgtcccgacctcggaaggcattttgcgcgccagcacgcgcacggtggtttcgtccgccctgacgattttggcggtcgattttatattgaccgcgtggatgtttacagattga

SEQ ID NO: 2508 - protein, 258 aa, Neisseria meningitidis; identical to SEQ ID NO: 2506

SEQ ID NO: 2509 - DNA, 327 bp, Neisseria gonorrhoeae
atgaacatcaaacaccttctcttgaccgccgccgcaaccgcactgttgggcatttccgcccccgcactcgcccaccacgacggacacggcgatgacgaccacggacacgccgcacaccaacacggcaaacaagacaaaatcatcagccgcgcccaagccgaaaaagcggcttgggcgcgtgtcggcggcaaaatcaccgacatcgatctcgaacacgacgacggccgtccgcactatgatgtcgaaatcgtcaaaaacggacaggaatacaaagtcgttgtcgatgcccgtaccggccgcgtgatttcctcccgccgcgacgactga

SEQ ID NO: 2510 - protein, 108 aa, Neisseria meningitidis
MNIKHLLLTAAATALLGISAPALAHHDGHGDDDHGHAAHQHGKQDKIISRAQAEKAAWARVGGKITDIDLEHDDGRPHYDVEIVKNGQEYKVVVDARTGRVISSRRDD

SEQ ID NO: 2511 - DNA, 327 bp, Neisseria meningitidis
atgaacatcaaacaccttctcttgacctccgccgcaaccgcactgctgagcatttccgcccccgcgctcgcccaccacgacggacacggcgatgacgaccacggacacgccgcacaccaacacaacaaacaagacaaaatcatcagccgcgcccaagccgaaaaagcagcgttggcgcgtgtcggcggcaaaatcaccgacatcgatctcgaacacgacaacggccgtccgcactatgatgtcgaaatcgtcaaaaacggacaggaatacaaagtcgttgtcgatgcccgtaccggccgcgtgatttcctcccgccgcgacgactga

SEQ ID NO: 2512 - protein, 108 aa, Neisseria meningitidis
MNIKHLLLTSAATALLSISAPALAHHDGHGDDDHGHAAHQHNKQDKIISRAQAEKAALARVGGKITDIDLEHDNGRPHYDVEIVKNGQEYKVVVDARTGRVISSRRDD

SEQ ID NO: 2513 - DNA, 327 bp, Neisseria meningitidis
atgaacttcaaacgccttctcttgaccgccgccgcaaccgcactgatgggcatttccgcccccgcactcgcccaccacgacggacacggcgatgacgaccacggacacgccgcacaccaacacagcaaacaagacaaaatcatcagccgcgcccaagccgaaaaagcagcgttggcgcgtgtcggcggcaaaatcaccgacatcgatctcgaacacgacaacggccgtccgcactatgatgtcgaaatcgtcaaaaacggacaggaatacaaagtcgttgtcgatgcccgtaccggccgcgtgatttcctcccgccgcgacgactga

SEQ ID NO: 2514 - protein, 108 aa, Neisseria meningitidis
MNFKRLLLTAAATALMGISAPALAHHDGHGDDDHGHAAHQHSKQDKIISRAQAEKAALARVGGKITDIDLEHDNGRPHYDVEIVKNGQEYKVVVDARTGRVISSRRDD

SEQ ID NO: 2515 - DNA, 1815 bp, Neisseria gonorrhoeae
atgtccgctgaaacgaccgtatccggcgcgcgccccgccgccaaactgccgatttacatcctgccctgcttcctttggataggcatcatcccctttaccttcgcactcaggctgaaaccgtcgcccgacttttaccacgatgccgccgccgcggccggcctgattgtcctgttgttcctcacggcaggaaaaaagctgtttgatgtcaaaatccccgccatcagcttcctcctgtttgcaatggcggcattttggtggcttcaggcacgcctgatgaacctgatttatcccggaatgaacgacatcgcctcttgggttttcatcttgctcgccgtcagcgcgtgggcctgcaagagtttggtcgcacactacggacaagaacgcatcgttaccctgtttgcctggtcgctgcttatcggctccctgcttcaatcctgcatcgtcgtcatccagtttgccggctgggaaaacacccccctgcttcaaaacatcatcgttcacagagggcaaggcgtaatcggacacatcgggcagcgcaacaacctcggacactacctcatgtggggcatactcgcctccgcctacctcaacggacaacgaaaaatccccgcagccctcggcgcaatctgcctgattatgcagaccgccgttttaggtttggtcaattcgcgcaccatcttgacctacatagccgccatcgccctcatccttcccttctggtatttccgttcggacaaatccaacagacggacgatgctcggcatagccgcagccgtattccttaccgcgctgttccaattttccatgaacgccattctggaaacctttacaggcatccgctacgaaactgccgtcgaacgcgtcgccaacggcggtttcacagacttgccgcgccaaagcgaatggaataaagcccttgccgccttccagtccgccccgatattcgggcacggctggaacagttttgcccaacaaaccttcctgatcaatgccgaacagcacaccatacacgacaacttcctcagcaccttgttcacccattcccacaacatcatcctccaactccttgcagaaatggggatcagcggcacgcttctggttgccgcaaccctgctgacgggcattgccgggctgctgaaacgctccctgacccccgcatcacttttcctgctgtgcgcgcttgccgtcagtatgtgccacagtatgctcgaatatcctttgtggtatgtctatttcctcatccccttcggactgatgctctttctgtcccccgcagaggcttcagacggcatcgccttcaaaaaagccgccaatctcggcatactgaccgcctccgccgccatattcgcaggattgctgcacttggactggacatacacccggctggttaactccttttcccccgccgctgacgacagtgccaaaaccctcaaccggaaaatcaacgaactgcgctatatttccgcaaacagcccgatgctgtccttttatgccgacttctccctcgtaaacttcgccctgccggaataccccgaaacccagacttgggcggaagaagcaaccctcaaagcactaaaataccgcccctactccgccacctaccgcatcgccctctacttgatgcggcaaggcaaagttgcagaagcaaaacaatggatgcgggcaacacagtcctattacccctacctgatgccccgatacgccgacgaaatccgcaaactgcccgtatgggcaccgctgctgcccgaactgctcaaagactgcaaagccttcgccgccgctcccggccatccggaaacaaaaccctgcaaatga

SEQ ID NO: 2516 - protein, 604 aa, Neisseria gonorrhoeae
MSAETTVSGARPAAKLPIYILPCFLWIGIIPFTFALRLKPSPDFYHDAAAAAGLIVLLFLTAGKKLFDVKIPAISFLLFAMAAFWWLQARLMNLIYPGMNDIASWVFILLAVSAWACKSLVAHYGQERIVTLFAWSLLIGSLLQSCIVVIQFAGWENTPLLQNIIVHRGQGVIGHIGQRNNLGHYLMWGILASAYLNGQRKIPAALGAICLIMQTAVLGLVNSRTILTYIAAIALILPFWYFRSDKSNRRTMLGIAAAVFLTALFQFSMNAILETFTGIRYETAVERVANGGFTDLPRQSEWNKALAAFQSAPIFGHGWNSFAQQTFLINAEQHTIHDNFLSTLFTHSHNIILQLLAEMGISGTLLVAATLLTGIAGLLKRSLTPASLFLLCALAVSMCHSMLEYPLWYVYFLIPFGLMLFLSPAEASDGIAFKKAANLGILTASAAIFAGLLHLDWTYTRLVNSFSPAADDSAKTLNRKINELRYISANSPMLSFYADFSLVNFALPEYPETQTWAEEATLKALKYRPYSATYRIALYLMRQGKVAEAKQWMRATQSYYPYLMPRYADEIRKLPVWAPLLPELLKDCKAFAAAPGHPETKPCK

SEQ ID NO: 2517 - DNA, 1815 bp, Neisseria meningitidis
atgcccgctgaaacgaccgtatccggcgcgcaccccgccgccaaactgccgatttacatcctgccctgcttcctttggataggcatcgtcccctttaccttcgcgctcaaactgaaaccgtcgcccgacttttaccacgatgccgccgccgcagccggcctgattgtcctgttgttcctcacggcaggaaaaaaactgtttgatgtcaaaatccccgccatcagcttccttctgtttgcaatggcggcgttttggtatcttcaggcacgcctgatgaacctgatttaccccggtatgaacgacatcgtctcttggattttcatcttgctcgccgtcagcgcgtgggcctgccggagcttggtcgcacacttcggacaagaacgcatcgtgaccctgtttgcctggtcgctgcttatcggctccctgcttcaatcctgcatcgtcgtcatccagtttgccggctgggaagacacccctctgtttcaaaacatcatcgtttacagcgggcaaggcgtaatcggacacatcgggcagcgcaacaacctcggacactacctcatgtggggcatactcgccgccgcctacctcaacggacaacgaaaaatccccgccgccctcggcgtaatctgcctgattatgcagaccgccgttttaggtttggtcaactcgcgcaccatcttgacctacatagccgccatcgccctcatccttcccttctggtatttccgttcggacaaatccaacaggcggacgatgctcggcatagccgcagccgtattccttaccgcgctgttccaattttccatgaacaccattctggaaacctttactggcatccgctacgaaactgccgtcgaacgcgtcgccaacggcggtttcacagacttgccgcgccaaatcgaatggaataaagcccttgccgccttccagtccgccccgatattcgggcacggctggaacagttttgcccaacaaaccttcctcatcaatgccgaacagcacaacatatacgacaacctcctcagcaacttgttcacccattcccacaacatcgtcctccaactccttgcagagatgggaatcagcggcacgcttctggttgccgcaaccctgctgacgggcattgccgggctgcttaaacgccccctgacccccgcatcgcttttcctaatctgcacgcttgccgtcagtatgtgccacagtatgctcgaatatcctttgtggtatgtctatttcctcatccctttcggactgatgctcttcctgtcccccgcagaggcttcagacggcatcgccttcaaaaaagccgccaatctcggcatactgaccgcctccgccgccatattcgcaggattgctgcacttggactggacatacacccggctggttaacgccttttcccccgccactgacgacagtgccaaaaccctcaaccggaaaatcaacgagttgcgctatatttccgcaaacagtccgatgctgtccttttatgccgacttctccctcgtaaacttcgccctgccggaataccccgaaacccagacttgggcggaagaagcaaccctcaaatcactaaaataccgcccccactccgccacctaccgcatcgccctctacctgatgcggcaaggcaaagttgcagaagcaaaacaatggatgcgggcgacacagtcctattacccgtacctgatgccccgatacgccgacgaaatccgcaaactgcccgtatgggcgccgctgctacccgaactgctcaaagactgcaaagccttcgccgccgcgcccggtcatccggaagcaaaaccctgcaaatga

SEQ ID NO: 2518 - protein, 604 aa, Neisseria meningitidis
MPAETTVSGAHPAAKLPIYILPCFLWIGIVPFTFALKLKPSPDFYHDAAAAAGLIVLLFLTAGKKLFDVKIPAISFLLFAMAAFWYLQARLMNLIYPGMNDIVSWIFILLAVSAWACRSLVAHFGQERIVTLFAWSLLIGSLLQSCIVVIQFAGWEDTPLFQNIIVYSGQGVIGHIGQRNNLGHYLMWGILAAAYLNGQRKIPAALGVICLIMQTAVLGLVNSRTILTYIAAIALILPFWYFRSDKSNRRTMLGIAAAVFLTALFQFSMNTILETFTGIRYETAVERVANGGFTDLPRQIEWNKALAAFQSAPIFGHGWNSFAQQTFLINAEQHNIYDNLLSNLFTHSHNIVLQLLAEMGISGTLLVAATLLTGIAGLLKRPLTPASLFLICTLAVSMCHSMLEYPLWYVYFLIPFGLMLFLSPAEASDGIAFKKAANLGILTASAAIFAGLLHLDWTYTRLVNAFSPATDDSAKTLNRKINELRYISANSPMLSFYADFSLVNFALPEYPETQTWAEEATLKSLKYRPHSATYRIALYLMRQGKVAEAKQWMRATQSYYPYLMPRYADEIRKLPVWAPLLPELLKDCKAFAAAPGHPEAKPCK

SEQ ID NO: 2519 - DNA, 1815 bp, Neisseria meningitidis
atgcccgctgaaacgaccgtatccggcgcgcaccccgccgccaaactgccgatttacatcctgccctgcttcctttggataggcatcgtcccctttacctttgcgctcaggctgcaaccgtcgcccgacttttaccacgatgccgccgccgcagccggcctgattgtcctgttgttcctcacggcaggaaaaaagctgtttgatgtcaaaatcccacctatcagcttccttctgtttgcaatggcggcgttttggtatcttcaggcacgcctgatgaacctgatttaccccggtatgaacgacatcgtctcttggattttcatcttactcgccgtcagcgcgtgggcctgccggagcttggtcgcacactacggacaagaacgcatcgttaccctgtttgcctggtcgctgcttatcggctccctgcttcaatcctgcatcgtcgtcatccagtttgccggctgggaagacacccctctgtttcaaaacatcattgtttacagcgggcaaggcgtaatcggacacatcggacagcgcaacaacctcggacactacctcatgtggggcatactcgccgccgcctacctcaacggacaacgaaaaatcccgcccgccttgggtgcaatctgcctgattatgcagaccgccgttttaggtttggtcaattcgcgcaccatcttgacctacatagccgccatcgccctcatccttcccttctggtatttccgttcggacaaatccaacaggcggacgatactcggcatagccgcagccgtattccttaccgcgctgttccaattttccatgaacaccattctggaaacctttaccggcatccgctacgaaaccgccgtcgaacgcgtcgccaacggcggtttcacagacctgccgcgccaaatcgaatggcgcaaagccctcgccgccttccagtccgccccgatattcgggcacggctggaacagttttgcccaacaaaccttcctcatcaatgccgaacagcacaacatacacgacaacctcctcagcaacttgttcacccattcccacaacatcgttctccaactccttgcagagatggggatcagcggcacgcttctggttgccgcaaccctgctgacgggcattgccgggctgctgaaacgccccctgacccccgcatcgcttttcctgatctgcacacttgccgtcagtatgtgccacagtatgctcgaatatcctttgtggtatgtctatttcctcatccccttcggactgatgctctttctgtcccccgcagaggcttcagacggcatcgccttcaaaaaagccgccaatctcggcatactaaccgcctccgccgccatattcgcaggattgctgcacttggactggacatacacccggatggttaacgccttttcccccgccactgacgacagtgccaaaaccctcaaccggaaaatcaacgagttgcgctatatttccgcaaacagtccgatgctgtccttttatgccgacttctccctcgtaaacttcgccctgccggaataccccgaaacccagacttgggcggaagaagcaaccctcaaatcactaaaataccgcccccactccgccacctaccgcatcgccctctacctgatgcggcaaggcaaagttgcagaagcaaaacaatggatgcgggcgacacagtcctattacccctacctgatgccccgatacgccgacgaaatccgcaaactgcccgtatgggcgccgctgctacccgaactgctcaaagactgcaaagccttcgccgccgcgcccggtcatccggaagcaaaaccctgcaaatga

SEQ ID NO: 2520 - protein, 604 aa, Neisseria meningitidis
MPAETTVSGAHPAAKLPIYILPCFLWIGIVPFTFALRLQPSPDFYHDAAAAAGLIVLLFLTAGKKLFDVKIPPISFLLFAMAAFWYLQARLMNLIYPGMNDIVSWIFILLAVSAWACRSLVAHYGQERIVTLFAWSLLIGSLLQSCIVVIQFAGWEDTPLFQNIIVYSGQGVIGHIGQRNNLGHYLMWGILAAAYLNGQRKIPPALGAICLIMQTAVLGLVNSRTILTYIAAIALILPFWYFRSDKSNRRTILGIAAAVFLTALFQFSMNTILETFTGIRYETAVERVANGGFTDLPRQIEWRKALAAFQSAPIFGHGWNSFAQQTFLINAEQHNIHDNLLSNLFTHSHNIVLQLLAEMGISGTLLVAATLLTGIAGLLKRPLTPASLFLICTLAVSMCHSMLEYPLWYVYFLIPFGLMLFLSPAEASDGIAFKKAANLGILTASAAIFAGLLHLDWTYTRMVNAFSPATDDSAKTLNRKINELRYISANSPMLSFYADFSLVNFALPEYPETQTWAEEATLKSLKYRPHSATYRIALYLMRQGKVAEAKQWMRATQSYYPYLMPRYADEIRKLPVWAPLLPELLKDCKAFAAAPGHPEAKPCK

SEQ ID NO: 2521 - DNA, 594 bp, Neisseria gonorrhoeae
atggcaaaaaaaccgaacaaacccttcaggctgacccccaaactcctgatacgcgccgtattgctcatctgtatcaccgccatcggcgcattggcagtaggcatcgtcagcacattcaacccgaacggcgacaaaaccctccaaaccgaaccgcaacacaccgacagcccccgcgaaaccgaattctggctgccaaacggcgccgtcggacaagatgccgcccaacccgaacaccaccacgccgcctcatccgaacccgcacagccggacggcacagaagaaagcggcagcggactgccgtcccctgccgcacccaagaaaaaccgggtcaaaccgcgcccttcggatgcggcccgggcagccgattcgttaaccggcaccggaacacaagctgaaaacacactcaaagaaacccccgtactgcccacaaacgccccccatcccgaaccccgaaaagaaacacccgaaaaacaggcgcagcccaaagaaacacccaaagaaaaagaaacgcccaaagaaaaccataccaaaccggacaccccgaaaaacacgccggccaaaccccataaagagattctcgacaacctcttttga

SEQ ID NO: 2522 - protein, 197 aa, Neisseria gonorrhoeae
MAKKPNKPFRLTPKLLIRAVLLICITAIGALAVGIVSTFNPNGDKTLQTEPQHTDSPRETEFWLPNGAVGQDAAQPEHHHAASSEPAQPDGTEESGSGLPSPAAPKKNRVKPRPSDAARAADSLTGTGTQAENTLKETPVLPTNAPHPEPRKETPEKQAQPKETPKEKETPKENHTKPDTPKNTPAKPHKEILDNLF

SEQ ID NO: 2523 - DNA, 573 bp, Neisseria meningitidis
atggcaaaaaaaccgaacaaacccttcaggctgacccccaaactcctgatacgcgccgtattgctcatctgtatcgccgccatcggcgcattggcaataggcatcgtcagcacattcaacccgaacggcgacaaaacccttcaagccgaaccgcaacacaccgacagcccccgcgaaaccgaattctggctgccaaacggcgtagtcggacaagatgccgcccaacccgaacaccaccacgccgcctcatccgaacccgcacagccggacggcacagacgaaagcggcagcggactgccgtcccctgccgcacccaagaaaaaccgggtcaaaccgcaacctgccgacacagctcaaaccgacaggcagccggacgacgccggaacacaagctgaaaacacactcaaagaaacccccgtactgcccacaaacgtcccccgtcccgaaccccgaaaagaaacacccgaaaaacaggcgcagcccaaagaaacgcccaaagaaaaccataccaaaccggacaccccgaaaaacacgccgcccaaaccccataaagaaattctcgacaaactcttc

SEQ ID NO: 2524 - protein, 191 aa, Neisseria meningitidis
MAKKPNKPFRLTPKLLIRAVLLICIAAIGALAIGIVSTFNPNGDKTLQAEPQHTDSPRETEFWLPNGVVGQDAAQPEHHHAASSEPAQPDGTDESGSGLPSPAAPKKNRVKPQPADTAQTDRQPDDAGTQAENTLKETPVLPTNVPRPEPRKETPEKQAQPKETPKENHTKPDTPKNTPPKPHKEILDKLF

SEQ ID NO: 2525 - DNA, 594 bp, Neisseria meningitidis
atggcaaaaaaaccgaacaaacccttcaggctgacccccaaactcctgatacgcgccgtattgctcatctgtatcaccgccatcggcgcattggcaataggcatcgtcagcacattcaacccgaacggcgacaaaaccctccaaaccgaaccgcaacacaccgacagcccccgcgaaaccgaattctggctgccaaacggcgtagtcggacaagatgccgcccaacccgaacaccaccacgcctcctcatccgcacccgcacagccggacggcacagacgaaagcggcagcggactgccgtcccctgccgcacccaagaaaaaccgggtcaaaccgcaacctgccgacacagctcaaaccgacaggcagccggacgacgccggagcacaagctgaaaacacactcaaagaaacccccgtactgcccacaaacgtcccccgtcccgaaccccgaaaagaaacacccgaaaaacaggcacagcccaaagaaacacccaaagaaaaagaaacgcccaaagaaaaccataccaaaccggacaccccgaaaaacacgccgcctaaaccccataaagaaattctcgacaacctcttctga

SEQ ID NO: 2526 - protein, 197 aa, Neisseria meningitidis
MAKKPNKPFRLTPKLLIRAVLLICITAIGALAIGIVSTFNPNGDKTLQTEPQHTDSPRETEFWLPNGVVGQDAAQPEHHHASSSAPAQPDGTDESGSGLPSPAAPKKNRVKPQPADTAQTDRQPDDAGAQAENTLKETPVLPTNVPRPEPRKETPEKQAQPKETPKEKETPKENHTKPDTPKNTPPKPHKEILDNLF

SEQ ID NO: 2527 - DNA, 279 bp, Neisseria gonorrhoeae
atgtcccgaaacctgcttgtccgctggctcgccgtctgcctcatccccttggcgacgcttgccgttttcgccgccaatccgcccgaagacaaaccccagcatctgatcaacggcatcatccttgcctgcgaagcgacgtttttgtttaaattcgtgctctttgaaaccatcaagcatcatcttaaacaagggtttgatttgaaacgtcaaaccatgtttctgtttattccgattgttttgctggttgtgtatttgttccactatttcggcgcgttttag

SEQ ID NO: 2528 - protein, 92 aa, Neisseria gonorrhoeae
MSRNLLVRWLAVCLIPLATLAVFAANPPEDKPQHLINGIILACEATFLFKFVLFETIKHHLKQGFDLKRQTMFLFIPIVLLVVYLFHYFGAF

SEQ ID NO: 2529 - DNA, 279 bp, Neisseria meningitidis
atgtcccgaaacctgcttgtccgctggcttgccgtctgcctcatcccgttggcgacgcttgccgttttcgccgccaatccgcccgaagacaaactccagcatctgatcaacggcatcatccttgcctgcgaagcgacgtttttgtttaaattcgtccttttcgacaccatcaagcatcatttgaaacaagagtttgatttgaaacgtcaaactatgttgctgtttattccgattattttgctgattgtgtatttgttccactattttggcgcgttttag

SEQ ID NO: 2530 - protein, 92 aa, Neisseria meningitidis
MSRNLLVRWLAVCLIPLATLAVFAANPPEDKLQHLINGIILACEATFLFKFVLFDTIKHHLKQEFDLKRQTMLLFIPIILLIVYLFHYFGAF

SEQ ID NO: 2531 - DNA, 279 bp, Neisseria meningitidis
atgtcccgaaacctgcttgtccgctggcttgtcgtctgcctgatacccttggcgacgcttgccgttttcgccgccaatccgcccgaagacaaaccccagcatctgattaacggcatcatccttgcctgcgaagcgacgtttttgttcaaattcgtccttttcgacaccatcaagcatcatttgaaacaagagtttgatttgaaacgtcaaactatgttgctgtttattccgattattttgctgattgtgtatttgttccactattttggcgcgttttag

SEQ ID NO: 2532 - protein, 92 aa, Neisseria meningitidis
MSRNLLVRWLVVCLIPLATLAVFAANPPEDKPQHLINGIILACEATFLFKFVLFDTIKHHLKQEFDLKRQTMLLFIPIILLIVYLFHYFGAF

SEQ ID NO: 2533 - DNA, 840 bp, Neisseria gonorrhoeae
gtgaaccgaactaccttctgctgcctttctttgaccgccggccctgattctgaccgcctgcagcagcggaggggcggaggcggtggtgtcgccgccgacatcggcacggggcttgccgatgcattaaccgcgccgctcgaccataaagacaaaggtttgaaatccctaacattggaagcctccattccccaaaacggaacactgaccctgtcggcacaaggtgcggaaaaaactttcaaagccggcggcaaagacaacagcctcaacacgggcaaactgaagaacgacaaaatcagccgcttcgacttcgtgcaaaaaatcgaagtggacggacaaaccatcacactggcaagcggcgaatttcaaatatacaaacaggatcactccgccgtcgttgccctacggattgaaaaaatcaacaaccccgacaaaatcgacagcctgataaaccaacgctccttccttgtcagcgatttgggcggagaacataccgccttcaaccaactgcctgacggcaaagccgagtatcacggcaaagcattcagctccgacgatgccgacggaaaactgacctataccatagatttcgccgccaaacagggacacggcaaaatcgaacacctgaaaacacccgagcagaatgttgagcttgcctccgccgaactcaaagcagatgaaaaatcacacgccgtcattttgggcgacacgcgctacggcggcgaagagaaaggcacttaccgcctcgcccttttcggcgaccgcgcccaagaaatcgctggctcggcaaccgtgaagataggggaaaaggttcacgaaatcggcatcgccgacaaacagtag

SEQ ID NO: 2534 - protein, 279 aa, Neisseria gonorrhoeae
VNRTTFCCLSLTAGPDSDRLQQRRGGGGGVAADIGTGLADALTAPLDHKDKGLKSLTLEASIPQNGTLTLSAQGAEKTFKAGGKDNSLNTGKLKNDKISRFDFVQKIEVDGQTITLASGEFQIYKQDHSAVVALRIEKINNPDKIDSLINQRSFLVSDLGGEHTAFNQLPDGKAEYHGKAFSSDDADGKLTYTIDFAAKQGHGKIEHLKTPEQNVELASAELKADEKSHAVILGDTRYGGEEKGTYRLALFGDRAQEIAGSATVKIGEKVHEIGIADKQ

SEQ ID NO: 2535 - DNA, 825 bp, Neisseria meningitidis
gtgaatcgaactgccttctgctgcctttctctgaccactgccctgattctgaccgcctgcagcagcggagggggtggtgtcgccgccgacatcggtgcggggcttgccgatgcactaaccgcaccgctcgaccataaagacaaaggtttgcagtctttgacgctggatcagtccgtcaggaaaaacgagaaactgaagctggcggcacaaggtgcggaaaaaacttatggaaacggtgacagcctcaatacgggcaaattgaagaacgacaaggtcagccgtttcgactttatccgccaaatcgaagtggacgggcagctcattaccttggagagtggagagttccaagtatacaaacaaagccattccgccttaaccgcctttcagaccgagcaaatacaagattcggagcattccgggaagatggttgcgaaacgccagttcagaatcggcgacatagcgggcgaacatacatcttttgacaagcttcccgaaggcggcagggcgacatatcgcgggacggcgttcggttcagacgatgccggcggaaaactgacctacaccatagatttcgccgccaagcagggaaacggcaaaatcgaacatttgaaatcgccagaactcaatgtcgacctggccgccgccgatatcaagccggatggaaaacgccatgccgtcatcagcggttccgtcctttacaaccaagccgagaaaggcagttactccctcggtatctttggcggaaaagcccaggaagttgccggcagcgcggaagtgaaaaccgtaaacggcatacgccatatcggccttgccgccaagcaataa

SEQ ID NO: 2536 - protein, 274 aa, Neisseria meningitidis
VNRTAFCCLSLTTALILTACSSGGGGVAADIGAGLADALTAPLDHKDKGLQSLTLDQSVRKNEKLKLAAQGAEKTYGNGDSLNTGKLKNDKVSRFDFIRQIEVDGQLITLESGEFQVYKQSHSALTAFQTEQIQDSEHSGKMVAKRQFRIGDIAGEHTSFDKLPEGGRATYRGTAFGSDDAGGKLTYTIDFAAKQGNGKIEHLKSPELNVDLAAADIKPDGKRHAVISGSVLYNQAEKGSYSLGIFGGKAQEVAGSAEVKTVNGIRHIGLAAKQ

SEQ ID NO: 2537 - DNA, 825 bp, Neisseria meningitidis
gtgaaccgaactgccttctgctgcctttctttgaccgccgccctgattctgaccgcctgcagcagcggaggcggcggtgtcgccgccgacatcggcgcggtgcttgccgatgcactaaccgcaccgctcgaccataaagacaaaagtttgcagtctttgacgctggatcagtccgtcaggaaaaacgagaaactgaagctggcggcacaaggtgcggaaaaaacttatggaaacggcgacagcctcaatacgggcaaattgaagaacgacaaggtcagccgcttcgactttatccgtcaaatcgaagtggacgggcagctcattaccttggagagcggagagttccaagtgtacaaacaaagccattccgccttaaccgcccttcagaccgagcaagtacaagattcggagcattcagggaagatggttgcgaaacgccagttcagaatcggcgatatagcgggtgaacatacatcttttgacaagcttcccgaaggcggcagggcgacatatcgcgggacggcattcggttcagacgatgccagtggaaaactgacctacaccatagatttcgccgccaagcagggacacggcaaaatcgaacatttgaaatcgccagaactcaatgttgacctggccgcctccgatatcaagccggataaaaaacgccatgccgtcatcagcggttccgtcctttacaaccaagccgagaaaggcagttactctctaggcatctttggcgggcaagcccaggaagttgccggcagcgcagaagtggaaaccgcaaacggcatacgccatatcggtcttgccgccaagcagtaa

SEQ ID NO: 2538 - protein, 274 aa, Neisseria meningitidis
VNRTAFCCLSLTAALILTACSSGGGGVAADIGAVLADALTAPLDHKDKSLQSLTLDQSVRKNEKLKLAAQGAEKTYGNGDSLNTGKLKNDKVSRFDFIRQIEVDGQLITLESGEFQVYKQSHSALTALQTEQVQDSEHSGKMVAKRQFRIGDIAGEHTSFDKLPEGGRATYRGTAFGSDDASGKLTYTIDFAAKQGHGKIEHLKSPELNVDLAASDIKPDKKRHAVISGSVLYNQAEKGSYSLGIFGGQAQEVAGSAEVETANGIRHIGLAAKQ

SEQ ID NO: 2539 - DNA, 2352 bp, Neisseria meningitidis
atggtttacggcattgccgaagccgatgcgggcgacagcagtgtgcttactttgggcggcatgtatcagaagagtagggaggttcctgatttttcgggcattattttgccctgtgaaaatcagaaaactgccccgttcagttcaacgcctgcctgcaaccggcctttgcaactgccgcgcaacacttatttgggggaggattggtcgcggttaagtgccgacaaatacaaccttttctcaggattcaaacatgtgtttgacaacggttggcagctcaatgccgaagtgtcttataccaagaatgaatccgatgcgaaggtggggcagttttttctgaaaaacgaatatgcggcgggtttgtcgggtgaggatgcggtaggctttttgactgaaaaaaacgaagtcatcccgttcgagccgaaagataaggcattggagaaactgaaagcatatcgtgatgaaaccgccaaggaataccgggagcgcaaagacgattttgttaaaaaccgtttcgataatactgctttcgaacagtatcgcagccgccgtgccgcagaacgcaaagccggttttgacaagtgtatgagtgaccctttcgcgctggactttatctgtcaaggttcttggggggatccgggcgttgatgccgacaaggcggaatttgtcgataaagcccttgcgaaggagggcatctttaataatgcggcacaacgttttccaaacagcctgtatgactcttcctttaatcggaaggctaccgccaaccgacgatacagttatatgccgttgcggcataccaaagacgaccgccaatggggaattaaacttgacctgaccggcacatatgggctgttcgggcgggagcatgatttctttgtcggctatgcctacggtgatgaaaagatacgttcggaatatctagaaatctacgaacgccgctacagagtacgtccgaatacgggggcaacgcacggcgtgtatgcgggaagttgtcaggaggagccggacggcgatttgtcgtctcctttggtcagggggcataaagaacccgattggcaggcgtacgatgaaaaaggcaaccgtaccgtttatgccgaagaatgcaggaacgccaagaaaataaaaaccgagcccaagctcgatgccgaaggcaagcaggtgtattactatgacgaatacagcggcagccggacaccggtatatgtcgatgtatatgagctggacgaaaaaggcaacaagattcaggagaccaatcccgacggcacgcctgcctttaccggtttttccggtacggtgccggtttggaaaaccgtcaaagtggcagacgaccatgttcctgcgctgtataactacgccaaatacctcaacaccaacaaaacccattcgctgactgccagcacgcgtttcaacgtaaccggccgactgcaccttttgggcgggctgcactacacgcgctatgagacttcgcaaaccaaagatatgcctgtccgctatgggcagccggcaagcgattttcagacggcatcgagcattagggcggatcaggaccattacacggccaagatgcaaggtcataaattgacgccctatgcaggcattacctatgacttgacaccgcaacagagtatttacggaagttataccaaaatcttcaaacagcaggataatgtcgatgtcagtgccaaaaccgttttaccgcctttggtcggcacaaactatgaggtaggctggaaaggcgcgttcttgcaaggacggctgaatgcttcgttcgcattgttttacctcgaacagaaaaaccgcacggtcgtcgatttcggctatgttcccggagcaggcggcaagcaggggtcgttccaaaccgttgccaaaccgataggcaaagtggtcagcaggggtgcggaattcgagttgtcgggtgagttgaacgaagattggaaagtctttgcgggttacacctacaacaagagccgctacaaaaacgccgccgaagtcaacgccgaacgccttgccaaaaattccagtgcagacccgtacaacttcagcaatttcacacccgtgcacatattccgtttcggaacgagcttccatataccgaatacggggctgaccgtcggcggcggcgtgtccgcacaaagcggcacaagcagtctgtataacatcaggcagggcggctacgggctgatagacggtttcgtccgttacgaattgggcaaacacgccaaattgagcctcatcggtacgaacttaaacggacgcacttattttgagaacaactacaaccgtacgcgcggcgcaaacaacttctacggagagccgcgcactgtcagcatgaaactggattggcagttttaa

SEQ ID NO: 2540 - protein, 783 aa, Neisseria meningitidis
MVYGIAEADAGDSSVLTLGGMYQKSREVPDFSGIILPCENQKTAPFSSTPACNRPLQLPRNTYLGEDWSRLSADKYNLFSGFKHVFDNGWQLNAEVSYTKNESDAKVGQFFLKNEYAAGLSGEDAVGFLTEKNEVIPFEPKDKALEKLKAYRDETAKEYRERKDDFVKNRFDNTAFEQYRSRRAAERKAGFDKCMSDPFALDFICQGSWGDPGVDADKAEFVDKALAKEGIFNNAAQRFPNSLYDSSFNRKATANRRYSYMPLRHTKDDRQWGIKLDLTGTYGLFGREHDFFVGYAYGDEKIRSEYLEIYERRYRVRPNTGATHGVYAGSCQEEPDGDLSSPLVRGHKEPDWQAYDEKGNRTVYAEECRNAKKIKTEPKLDAEGKQVYYYDEYSGSRTPVYVDVYELDEKGNKIQETNPDGTPAFTGFSGTVPVWKTVKVADDHVPALYNYAKYLNTNKTHSLTASTRFNVTGRLHLLGGLHYTRYETSQTKDMPVRYGQPASDFQTASSIRADQDHYTAKMQGHKLTPYAGITYDLTPQQSIYGSYTKIFKQQDNVDVSAKTVLPPLVGTNYEVGWKGAFLQGRLNASFALFYLEQKNRTVVDFGYVPGAGGKQGSFQTVAKPIGKVVSRGAEFELSGELNEDWKVFAGYTYNKSRYKNAAEVNAERLAKNSSADPYNFSNFTPVHIFRFGTSFHIPNTGLTVGGGVSAQSGTSSLYNIRQGGYGLIDGFVRYELGKHAKLSLIGTNLNGRTYFENNYNRTRGANNFYGEPRTVSMKLDWQF

SEQ ID NO: 2541 - DNA, 2352 bp, Neisseria meningitidis
atggtttacggcattgccgaagccgatgcgggcgacagcagtgtgcttactttgggcggcatgtatcagaagagtagggaggttcctgatttttcgggcattattttgtcctgtgaaaatcagaaaactgccccgttcagttcaacgcctgcctgcaaccggcctttgcaactgccgcgcaacacttatttgggggaggattggtcgcggttgagtgctgacaaatacaaccttttctcaggtttcaaacatgtgtttgacaacggttggcagctcaatgccgaagtgtcttataccaagaatgaatccgatgcgaaggtggggcagttttttctgaaaaacgaacatgcggcgggtttgtcagatgaggatgcggtaggctttttgaccgaaaaaaacgaagtcatcccgttcgagccgaaagataaggcattggagaaactgaaagcatatcgtgacgaaaccgccaaggaataccgtgagcgcaaagacgattttgttaaaaaccgtttcgataatactgctttcgagcagtaccgcagccgccgtgccgcagaacgcaaagccggttttgacgagtgtatgagtgccccttttgcgctggactttatctgtcaaggttcttggggggatccgggtgttgatgccgacaagtcggaatttgtcgataaagcccttgcgaaggaaggcatctttaataatgcggcacaacgttttccaaacagcctgtatgactcttcctttaatcggaaggctaccgccaaccgacgatacagttatatgccgttgcggcataccaaagacgaccgccaatggggaattaaacttgacctgaccggcacatatgggctgttcgggcgggagcatgatttctttgtcggctatgcctacggcgatgaaaagatacgttccgaatatctggaaatctacgaacgccgccacagagtacgtccgaatacaggggcaacgcacggcgtgtatgcgggaagttgtcagggggagccggacggtgatttgtcttctcctttggtcagggggcataaagaacccgattggcaggcgtacgatgaaaaaggcaaccgtaccgtttatgccgaagaatgcaggaatgccaagaaaataaaaaccgagcccaagctcgatgccgaaggcaagcaggtgtattactatgacgaatacagcggcagccggacgccagtatatgtcgatgtatatgaactggatgaaaaaggcaataagattcaggagaccaatcccgacggcacgcctgcctttaccggtttttccggtacggtgccggtttggaaaaccgtcaaagtggccgacgaccatgttcctgcgctgtataactacgccaaatacctcaacaccaacaaaacccattcgctgactgccggcacgcgtttcaacgtaaccggccgactgcatcttttgggcgggctgcactacacgcgctatgaaacctcgcaaaccaaagatatgcctgtccgctatgggcagccggcaagcgattttcagacggcatcgagcattaaggcggatcaggaccattatacggccaagatgcaaggtcataaattgacgccctatgcaggcattacctatgatttgacaccgcaacagagtatttacggaagttataccaaaatcttcaaacagcaggataatgtcgatgtcagtgccaaaaccgttttaccgcctttggtcggcacaaactatgaggtaggctggaaaggcgcgttcttgcaaggacggctgaatgcttcgttcgcattgttttacctcgaacagaaaaaccgcacggtcgtcgattttggctatgttcccggagcaggcggcaagcaggggtcgttccaaaccgttgccaaaccgataggcaaagtggtcagcaggggtgcggaattcgagttgtcgggtgagttgaacgaagattggaaagtctttgcgggttacacctacaacaagagccgctacaaaaacgccgccgaagtcaacgccgaacgcctcgccaaaaacacaggcgcagacccgtacaacttcagcaatttcacacccgtgcacatattccgtttcggaacgagcttccatataccgaatacggggctgaccgtcggcggcggcgtgtccgcacaaagcggcacaagcagtctgtataacatcaggcagggcggctacgggctgatagacggtttcgtccgttacgaattgggcaaacacgctaaattgagcctcatcggtacgaacttaaacggacgcacttattttgagaacaactacaaccgtacgcgcggcgcaaacaacttctatggagagccgcgcactgtcagcatgaaactggattggcagttttaa

SEQ ID NO: 2542 - protein, 783 aa, Neisseria meningitidis
MVYGIAEADAGDSSVLTLGGMYQKSREVPDFSGIILSCENQKTAPFSSTPACNRPLQLPRNTYLGEDWSRLSADKYNLFSGFKHVFDNGWQLNAEVSYTKNESDAKVGQFFLKNEHAAGLSDEDAVGFLTEKNEVIPFEPKDKALEKLKAYRDETAKEYRERKDDFVKNRFDNTAFEQYRSRRAAERKAGFDECMSAPFALDFICQGSWGDPGVDADKSEFVDKALAKEGIFNNAAQRFPNSLYDSSFNRKATANRRYSYMPLRHTKDDRQWGIKLDLTGTYGLFGREHDFFVGYAYGDEKIRSEYLEIYERRHRVRPNTGATHGVYAGSCQGEPDGDLSSPLVRGHKEPDWQAYDEKGNRTVYAEECRNAKKIKTEPKLDAEGKQVYYYDEYSGSRTPVYVDVYELDEKGNKIQETNPDGTPAFTGFSGTVPVWKTVKVADDHVPALYNYAKYLNTNKTHSLTAGTRFNVTGRLHLLGGLHYTRYETSQTKDMPVRYGQPASDFQTASSIKADQDHYTAKMQGHKLTPYAGITYDLTPQQSIYGSYTKIFKQQDNVDVSAKTVLPPLVGTNYEVGWKGAFLQGRLNASFALFYLEQKNRTVVDFGYVPGAGGKQGSFQTVAKPIGKVVSRGAEFELSGELNEDWKVFAGYTYNKSRYKNAAEVNAERLAKNTGADPYNFSNFTPVHIFRFGTSFHIPNTGLTVGGGVSAQSGTSSLYNIRQGGYGLIDGFVRYELGKHAKLSLIGTNLNGRTYFENNYNRTRGANNFYGEPRTVSMKLDWQF

SEQ ID NO: 2543 - DNA, 564 bp, Neisseria meningitidis
atgaatcaaaatcatttttcacttaaaattctgaccgttatgctgttatcggcttacggtggttcttttgcagacggtgttgtgcctgtttcagacggcaataccgtcagtctggatacggtcaatgtacgcggctctcatgctttgttgggcaagaccgaaaagacccgttcttatacgatagatcggatgtccaccgccacaggtatgaggattgcgggcaaggatacgccgcagtcggtcagcgtcatcacgcgcagccgccttgacgataaggcggtgcatacgcttgaagaggcaatgaaaaacacgacgggtgtcaacgttgtgcgcgattcaggcttgcagacgcggtttttgtcacgcggtttctatattgatcagattggtgaagacggtatgaccgtcaatgttgcaggccgttcgggatatacggcgaaaatcgacgtgtctccgagtaccgatttggcggtttatgaccatattgaagttgtacggggtgcaacggggttgacccaatccaattcagagccgggaggaaccgtcaatttgatccgtaagtga

SEQ ID NO: 2544 - protein, 187 aa, Neisseria meningitidis
MNQNHFSLKILTVMLLSAYGGSFADGVVPVSDGNTVSLDTVNVRGSHALLGKTEKTRSYTIDRMSTATGMRIAGKDTPQSVSVITRSRLDDKAVHTLEEAMKNTTGVNVVRDSGLQTRFLSRGFYIDQIGEDGMTVNVAGRSGYTAKIDVSPSTDLAVYDHIEVVRGATGLTQSNSEPGGTVNLIRK

SEQ ID NO: 2545 - DNA, 564 bp, Neisseria meningitidis
atgaatcaaaatcatttttcacttaaaattctgaccgttatgctgttatcggcttacggtggttcttttgcagacggtgttgtgcctgtttcagacggcaataccgtcagtttggatacggtcaatgtacgcggctctcatgctctgtcgggcaagaccgagaagacccgttcttatacgatagatcggatgtccaccgccacaggtatgaggattgcgggcaaggatacgccgcagtcggtcagcgtcatcacgcgcagccgccttgacgataaggcggtgcatacgcttgaagaggcaatgaaaaacacgacgggtgtcaacgttgtgcgcgattcaggcttgcagacgcggtttttgtcacgcggtttctatattgatcagattggtgaagacggtattaccgtcaatgttgcaggccgttcgggatatacggcgaaaatcgacgtgtctccgagtaccgatttggcggtttatgaccatattgaagttgtacggggtgcaacggggttgacccaatccaattcagagccgggtggaaccgtcaatttgatccgtaagcga

SEQ ID NO: 2546 - protein, 188 aa, Neisseria meningitidis
MNQNHFSLKILTVMLLSAYGGSFADGVVPVSDGNTVSLDTVNVRGSHALSGKTEKTRSYTIDRMSTATGMRIAGKDTPQSVSVITRSRLDDKAVHTLEEAMKNTTGVNVVRDSGLQTRFLSRGFYIDQIGEDGITVNVAGRSGYTAKIDVSPSTDLAVYDHIEVVRGATGLTQSNSEPGGTVNLIRKR

SEQ ID NO: 2547 - DNA, 1596 bp, Neisseria meningitidis
atgaaaccgttaaaaacattagaatttggatttgtggatgctgcaaactacagaagaagagaaaataaagatttatttaaccgaatatttgtaaaaggagaatatttggatgaattatgtgaaccaaatatttcgtttttaatcggagaaaagggaactggaaagacagcatatgctgtttatttaactaataacttctataaaaacatacatgccactactaagtttgttcgtgaaaccgattattcaaaatttattcagctaaagaaagcaagacacttaactgtttcagattttacaagtatttggaaagtcattttatatctgttgatatcaaatcaaatcaaatgtaaagaaaacggaatattatcttcaatatttaataaatttaaagccttagatgaggctataaatgaatattattatggcgcttttgatccggaaattgtacaagcaataactttaatagaaaattcaaaagaagctgcggaaatgatttttggaaaatttgttaaactaggtgaagaggaatcccaacaaataacttttacagaaagtaaattccaagcaaatttaggttttattgaaagaaaatttaaagatgctttatctcagttaaagctaaaagataatcatattttgtttattgatgggatagatattagaccatcacagattccatttgatgaatatcatgagtgtgtaaaaggtcttgctaacgccatatggatgttaaataatgatatcttcccttccattaaagatagtaagggaaggatgagagttgtgttattgattagacctgatatctttgattcattaggtttacaaaatcaaaataccaaacttcaagataattcagtatttttagactggaggacggattataaatcttatagaagttcaaagatttttggcgtttttgatcatcttttgagaacccagcaagaaaaacaagatagtttagaaaaaggcaactcatgggattattattttccatggaatgctcctaatttacatgatgagtataaaaatttaacttcatttattagcttcctaagaaaatcgtattatcgacctcgcgatattcttcagatgcttactttgctacaaaaaaataagaaaagtaaggaagattatgtcgtagcagaagattttgataatacttcttttcaaagagaatactcgatatatttacttggtgaaatcaaagatcatcttttgttttattatagtcaaagtgattatcaaaatttcctgaaattttttgaatttttaaacgggaaagatagatttaaatatagtgattttttaaaagcatttgaacgtttgaaaaagcacttacaaacaacatcagtggaaatacctaaatttatgagtactgctaatgagtttttgcaatttttatttgacttgaatgttattgcttatttagataacccagaagatgaaacgaaaccatatatccattggtgctttaaagatagaaattatgcaaatatttctcctaaaataaaaactgaaactgaatatttaatattttcaggattatcaaaagcccttgatgttggtactccatttaagaacaaacagtaa

SEQ ID NO: 2548 - protein, 531 aa, Neisseria meningitidis
MKPLKTLEFGFVDAANYRRRENKDLFNRIFVKGEYLDELCEPNISFLIGEKGTGKTAYAVYLTNNFYKNIHATTKFVRETDYSKFIQLKKARHLTVSDFTSIWKVILYLLISNQIKCKENGILSSIFNKFKALDEAINEYYYGAFDPEIVQAITLIENSKEAAEMIFGKFVKLGEEESQQITFTESKFQANLGFIERKFKDALSQLKLKDNHILFIDGIDIRPSQIPFDEYHECVKGLANAIWMLNNDIFPSIKDSKGRMRVVLLIRPDIFDSLGLQNQNTKLQDNSVFLDWRTDYKSYRSSKIFGVFDHLLRTQQEKQDSLEKGNSWDYYFPWNAPNLHDEYKNLTSFISFLRKSYYRPRDILQMLTLLQKNKKSKEDYVVAEDFDNTSFQREYSIYLLGEIKDHLLFYYSQSDYQNFLKFFEFLNGKDRFKYSDFLKAFERLKKHLQTTSVEIPKFMSTANEFLQFLFDLNVIAYLDNPEDETKPYIHWCFKDRNYANISPKIKTETEYLIFSGLSKALDVGTPFKNKQ

SEQ ID NO: 2549 - DNA, 492 bp, Neisseria meningitidis
atgttttggcaactgaccgttgtttcagtaaccgccgtcattgcactggggacaatattcatcaataagaaaacttcaaagcaaaaggcgacattagatgttattttgaatgattaccaagatgcacaatttgtagaagccgacaatcatatttcgccttatattcgcggcacggcagttgacgacaacaacgcgcggatcgacctgtatgaaatttatcaaaataagggcggacaatgggaaaaagagagagggcatttacttaccgtaatcaatcggcacgagttttatgcgtgcgcaatcaactcgggagtattggatgaggatttgtttaaacggctgcattgcaccaacttcataaaattgtggaatgcagtttcgcctcttgttatgaaaatacgcgaagaagaacgcaaagacacaatatttagagagttggaaattttggttgcattatggaaagcaaaccccctaaaggcatctgatttgtga

SEQ ID NO: 2550 - protein, 163 aa, Neisseria meningitidis
MFWQLTVVSVTAVIALGTIFINKKTSKQKATLDVILNDYQDAQFVEADNHISPYIRGTAVDDNNARIDLYEIYQNKGGQWEKERGHLLTVINRHEFYACAINSGVLDEDLFKRLHCTNFIKLWNAVSPLVMKIREEERKDTIFRELEILVALWKANPLKASDL

SEQ ID NO: 2551 - DNA, 1041 bp, Neisseria gonorrhoeae
atgtccgaaaacaaacaaaacgaagtcctgaccggttacgaacagctgaaacggcgcaaccgccgccgcctcgtaacggcaagctccctggttgccgcctcctgcatcctgctggcagccgcactcagttccgatcctgccgacagcaatcccgcaccgcaggccggcgaaaccggcgcaacggaaagccaaacggcaaacacggcacaaacccctgccttgaaatccgccgccgaaaacggggaaaccgccgccgacaaaccgcaggacttggcaggcgaagacaagccttctgccgccgacagcgaaatcagcgagcctgaaaacgtaggcgcgccgctggtgctgattaacgaccggctcgaagacagcaacatcaaaggtttggaagaatccgagaaactgcaacaggcagaaaccgccaaaaccgaaccgaagcaggcaaaacaacgcgctgccgaaaaagtgtcggcaactgccgacagtacggatacggtagcggttgaaaaaccgaaacgcactgccgaacccaaaccgcaaaaagcggaacgcactgccgaagccaagcccaaagccaaagaaaccaaaaccgccgaaaaagttgccgacaaaccgaaaactgctgccgaaaaaaccaaaccggatacggcaaaatccgacagcgcggtaaaagaagcgaaaaaagccgacaaggctgaaggcaaaaagacagccgaaaaagaccgttcggacggcaaaaaacacgaaacggcgcaaaaaaccgacaaagcggacaaaaccaaaaccgccgagaaggaaaaatccggcaaggcgggcaaaaaagccgccattcaggcaggttatgccgaaaaagaacgcgccttgagcctccagcgcaaaatgaaggcggcgggtatcgattcgaccatcaccgaaatcatgaccgacaacggcaaagtttaccgcgtcaaatcaagcaactataaaaacgcaagggatgccgaacgcgatttgaacaaactgcgcgtgcacggcatcgccggccaggtaacgaatgaatag

SEQ ID NO: 2552 - protein, 346 aa, Neisseria gonorrhoeae
MSENKQNEVLTGYEQLKRRNRRRLVTASSLVAASCILLAAALSSDPADSNPAPQAGETGATESQTANTAQTPALKSAAENGETAADKPQDLAGEDKPSAADSEISEPENVGAPLVLINDRLEDSNIKGLEESEKLQQAETAKTEPKQAKQRAAEKVSATADSTDTVAVEKPKRTAEPKPQKAERTAEAKPKAKETKTAEKVADKPKTAAEKTKPDTAKSDSAVKEAKKADKAEGKKTAEKDRSDGKKHETAQKTDKADKTKTAEKEKSGKAGKKAAIQAGYAEKERALSLQRKMKAAGIDSTITEIMTDNGKVYRVKSSNYKNARDAERDLNKLRVHGIAGQVTNE

SEQ ID NO: 2553 - DNA, 999 bp, Neisseria meningitidis
atgtccgaaaacaaacaaaacgaagtcctgagcggttacgaacaactcaaacggcgcaaccgccgccgcctcgtaacggcaagttgcctggttgccgcctcctgcatcctgctggcagccgccctcagttccggccctgccgaacagactgccggcgaaacaagcggcgtagaaaacaaagcggcaggtgcggcacaaacccctgccttgaaatccgccgccgacaaaccgcaggacttggcaggcgaagacaagccttctgccgccgacagcgaaatcagcgagcctgaaaacgtaggcgcgccgctggtgctgattaacgagcgcctcgaagacagcaacatcaaaggtttggaagcatccgagaaactgcaacaggcagaaaccgccaaaaccgcaccgaagcaggcaaaacaacgcgctgccgaaaaagtgccggcaactgccgacagtacggatacggtagcggttgaaaaaccgaaacgcactgccgaaacaaaaccgcaaaaagcggaacgcactgccaaagccaagcccaaagccaaagaaaccaaaaccgccgaaaaagttgccgacaaaccgaaaactgccgccgaaaaaaccaaaccggatacggcaaaatccgacagcgcggtaaaagaagcgaaaaaagccgacaaggctgaaagcaaaaaaacagccgaaaaagaccgttcggacggcaaaaaacacgaaacggcacaaaaaaccgacaaagcggacaagaccaaaaccgccgagaaggaaaaatccggtaaaaaagccgccattcaggcaggttatgccgaaaaagaacgcgccttaagcctccagcgcaaaatgaaggcggcgggtatcgattcgaccatcaccgaaattatgaccgacaacggcaaagtttaccgcgtcaaatcaagcaactataaaaacgcaagggatgccgaacgcgatttgaacaaattgcgcgtacacggtatcgccggtcaggtaacgaatgaatag

SEQ ID NO: 2554 - protein, 332 aa, Neisseria meningitidis
MSENKQNEVLSGYEQLKRRNRRRLVTASCLVAASCILLAAALSSGPAEQTAGETSGVENKAAGAAQTPALKSAADKPQDLAGEDKPSAADSEISEPENVGAPLVLINERLEDSNIKGLEASEKLQQAETAKTAPKQAKQRAAEKVPATADSTDTVAVEKPKRTAETKPQKAERTAKAKPKAKETKTAEKVADKPKTAAEKTKPDTAKSDSAVKEAKKADKAESKKTAEKDRSDGKKHETAQKTDKADKTKTAEKEKSGKKAAIQAGYAEKERALSLQRKMKAAGIDSTITEIMTDNGKVYRVKSSNYKNARDAERDLNKLRVHGIAGQVTNE

SEQ ID NO: 2555 - DNA, 999 bp, Neisseria meningitidis
atgtccgaaaacaaacaaaacgaagtcctgagcggttacgaacaactcaaacggcgcaaccgccgccgcctcgtaacggcaagttgcctggttgccgcctcctgcatcctgctggcagccgccctcagttccggccctgccgaacagactgccggcgaaacaagcggcgtagaaaacaaagcggcaggtgcggcacaaacccctgccttgaaatccgccgccgacaaaccgcaggacttggcaggcgaagacaagccttctgccgccgacagcgaaatcagcgagcctgaaaacgtaggcgcgccgctggtgctgattaacgaccgcctcgaagacagcaacatcaaaggtttggaagcatccgagaaactgcaacaggcagaaaccgccaaaaccgcaccgaagcaggcaaaacaacgcgctgccgaaaaagtgccggcaactgccgacagtacggatacggtagcggttgaaaaaccgaaacgcactgccgaaacaaaaccgcaaaaagcggaacgcactgccaaagccaagcccaaagccaaagaaaccaaaaccgccgaaaaagttgccgacaaaccgaaaactgccgccgaaaaaaccaaaccggatacggcaaaatccgacagcgcggtaaaagaagcgaaaaaagccgacaaggctgaaagcaaaaaaacagccgaaaaagaccgttcggacggcaaaaaacacgaaacggcacaaaaaaccgacaaagcggacaagaccaaaaccgccgagaaggaaaaatccggtaaaaaagccgccattcaggcaggttatgccgaaaaagaacgcgccttaagcctccagcgcaaaatgaaggcggcgggtatcgattcgaccatcaccgaaattatgaccgacaacggcaaagtttaccgcgtcaaatcaagcaactataaaaacgcaagggatgccgaacgcgatttgaacaaattgcgcgtacacggtatcgccggtcaggtaacgaatgaataa

SEQ ID NO: 2556 - protein, 332 aa, Neisseria meningitidis
MSENKQNEVLSGYEQLKRRNRRRLVTASCLVAASCILLAAALSSGPAEQTAGETSGVENKAAGAAQTPALKSAADKPQDLAGEDKPSAADSEISEPENVGAPLVLINDRLEDSNIKGLEASEKLQQAETAKTAPKQAKQRAAEKVPATADSTDTVAVEKPKRTAETKPQKAERTAKAKPKAKETKTAEKVADKPKTAAEKTKPDTAKSDSAVKEAKKADKAESKKTAEKDRSDGKKHETAQKTDKADKTKTAEKEKSGKKAAIQAGYAEKERALSLQRKMKAAGIDSTITEIMTDNGKVYRVKSSNYKNARDAERDLNKLRVHGIAGQVTNE

SEQ ID NO: 2557 - DNA, 309 bp, Neisseria meningitidis
ctgaccccttgggcggatgcatatgcagatttgcgcggcaaaaccaaagtgatgacgacccagatgggtgcttcccgcgatgtcagcaaaagcgccaaaggttggagtgtcggtatcggtctgaatgtaggcaaacagttgaccgacagcgtcggtctcgagtttgatccatactaccgtcacaaaacaatctacaaaccccgtgagattgtcttggacggtgacaaaaccaaaatgggccgctccaaatccaacgagtacggcttccgcgtagccgcaacgttctatagtcaattaaaatcaaaatag

SEQ ID NO: 2558 - protein, 102 aa, Neisseria meningitidis
LTPWADAYADLRGKTKVMTTQMGASRDVSKSAKGWSVGIGLNVGKQLTDSVGLEFDPYYRHKTIYKPREIVLDGDKTKMGRSKSNEYGFRVAATFYSQLKSK

SEQ ID NO: 2559 - DNA, 309 bp, Neisseria meningitidis
ctaaccccttgggcggatgcatatgcagatttgcgcggcaaaaccaaagtgatgacgacccagatgtgtgcttcccgcgatgtcagcaaaagcgccaaaggttggagtgtcggtatcggtctgaatgtaggcaaacagttgaccgacagcgtcggtctcgagtttgatccatactaccgtcacaaaacaatctgcaaaccccgtgagattgttttggacggcgacaaaaccaaaatgggccgctccaaatccaacgagtacggcttccgcgtaaccgcaacgttctatagtcaattaaaatcaaagtag

SEQ ID NO: 2560 - protein, 102 aa, Neisseria meningitidis
LTPWADAYADLRGKTKVMTTQMCASRDVSKSAKGWSVGIGLNVGKQLTDSVGLEFDPYYRHKTICKPREIVLDGDKTKMGRSKSNEYGFRVTATFYSQLKSK

SEQ ID NO: 2561 - DNA, 1266 bp, Neisseria gonorrhoeae
atgagtcaaaaccaacccgcacaaccgaccaaacgcaatctgttcaaaaccgcccttgccgtcggcgcaatcggcgcaatcggaggttatttcggcggcaaaaaacagggcgaaaccgccgaacgcaccgccgaaagccaacactcgccccaagcctatccctgctacggcgaacatcaggcaggtatcgttacgccgcggcaggcgttttccattatgtgcgccttcgacgtaaccgcgcaaagtgccaagcagctggaaaacctgttccgcacactgaccgcccgcatcgagtttctcacccaaggcggagaataccaagacggcgacgacaaactcccgtcagccggcagcggcattttgggtaaagccttcaaccccgacggattgaccgttaccgtgggggtgggcagcagcctgtttgacggccggttcggactcaaagacaaaaaaacggttcatttgcaggaaatgcgcgacttccccaacgataagctgcaaaaaagctggtgcgacggcgatttgagcctgcaaatctgcgccttcacccccgaaacctgccaaaccgccctgcgcgacatcatcaaacacaccgcccaaaccgccgtcatccgctggagtatcgacgggtggcagcctaaatccgaacccggcgcgatggcggcgcgcaacctgttgggcttccgagacggcacgggcaaccccaaggtttccgatcccaaaaccgccgacgaggttttatggacgggcgtggccgccaacagcctcgacgaaccggagtgggcgaaaaacggcagctatcaggcagtccgccttatccgccgctttgtcgagttttgggacaggacgccgcttcaagagcaaaccgacattttcgggcggcgaaaatacagcggggcgccgatggacggcaaaaaagaagccgaccaaccggatttcgccaaagaccccgagggtgatatcacgcccaaagacagccatatgcgcctggcgaatccgcgcgatcccgaattcctcaaaaaacactgcctcttccgccgcgcctacagctattctcgcggacccgcctcaagcggacagcttgatgtcgggctggtgttcgtctgctatcaggcaaatcttgccgacggtttcatcttcgtgcaaaacctcctcaacggcgaaccgctggaagaatacatcagccccttcggcggcggctatttcttcgtcttgcccggcgtgggaaaaggcggattcttgggacaagggctgccgggcgtataa

SEQ ID NO: 2562 - protein, 421 aa, Neisseria gonorrhoeae
MSQNQPAQPTKRNLFKTALAVGAIGAIGGYFGGKKQGETAERTAESQHSPQAYPCYGEHQAGIVTPRQAFSIMCAFDVTAQSAKQLENLFRTLTARIEFLTQGGEYQDGDDKLPSAGSGILGKAFNPDGLTVTVGVGSSLFDGRFGLKDKKTVHLQEMRDFPNDKLQKSWCDGDLSLQICAFTPETCQTALRDIIKHTAQTAVIRWSIDGWQPKSEPGAMAARNLLGFRDGTGNPKVSDPKTADEVLWTGVAANSLDEPEWAKNGSYQAVRLIRRFVEFWDRTPLQEQTDIFGRRKYSGAPMDGKKEADQPDFAKDPEGDITPKDSHMRLANPRDPEFLKKHCLFRRAYSYSRGPASSGQLDVGLVFVCYQANLADGFIFVQNLLNGEPLEEYISPFGGGYFFVLPGVGKGGFLGQGLPGV

SEQ ID NO: 2563 - DNA, 1266 bp, Neisseria meningitidis
atgagcaaaaaacaacccgcacaaccgaccaggcgcactctttttaaaaccgcgatcgcagccggagcagtcggcgcaatcggaggttatctcggcggcaaaaaacagggcgaaaccgccgaacgcaccgccgaaagccaacactcgccccaagcctatccctgctacggcgaacatcaggcaggcatcgttacgccgcagcaggcgttttcgattatgtgcgccttcgacgtaaccgcgcaaagtgccaagcagctggaaaacctgttccgcacgctgaccgcccgcatcgagtttctcacccaaggcggcgaataccaagacggcgacgacaaacttccgccagccggcagcggcattttgggcaaagccttcaaccccgacgggttgaccgttaccgtgggggtgggcagcagcctgtttgacggccggttcggactcaaagacaaaaaaccgattcatttgcaggaaatgcgcgacttctccaacgataagctgcaaaaaagctggtgcgacggcgatttgagcctgcaaatctgtgccttcacccccgaaacctgccaagccgccctgcgcgacatcatcaaacacaccgtccaaaccgccgttatccgttggagtatcgacgggtggcagcccaaatccgaacccggcgcgatggcggcgcgcaacctgttgggcttcagggacggcacgggcaaccccaaagtttccgatcccaaaactgccgacgaggttttgtggacgggggtggccgccaacagcctcgacgaaccggagtgggcgaaaaacggcagctatcaggcagtccgccttatccgccactttgtcgagttttgggacaggacgccgcttcaagagcaaaccgacattttcgggcggcgcaaatacagcggtgcgccgatggacggcaaaaaagaagccgaccaaccggattttgccaaagaccccgagggtgatatcacgcccaaagacagccatatacgcctggcgaatccgcgcgatcccgaattcctcaaaaaacaccgcctcttccgccgcgcctacagctattcgcgcggactcgcctcaagcggacagcttgatgtcgggctggtgttcgtctgctatcaggcaaaccttgccgacggattcatcttcgtgcaaaacctcctcaacggcgaaccgctggaagaatacatcagccccttcggcggcggctatttcttcgtcttgcccggcgtggaaaaaggcggctttttggggcaagggctgctgggcgtataa

SEQ ID NO: 2564 - protein, 421 aa, Neisseria meningitidis
MSKKQPAQPTRRTLFKTAIAAGAVGAIGGYLGGKKQGETAERTAESQHSPQAYPCYGEHQAGIVTPQQAFSIMCAFDVTAQSAKQLENLFRTLTARIEFLTQGGEYQDGDDKLPPAGSGILGKAFNPDGLTVTVGVGSSLFDGRFGLKDKKPIHLQEMRDFSNDKLQKSWCDGDLSLQICAFTPETCQAALRDIIKHTVQTAVIRWSIDGWQPKSEPGAMAARNLLGFRDGTGNPKVSDPKTADEVLWTGVAANSLDEPEWAKNGSYQAVRLIRHFVEFWDRTPLQEQTDIFGRRKYSGAPMDGKKEADQPDFAKDPEGDITPKDSHIRLANPRDPEFLKKHRLFRRAYSYSRGLASSGQLDVGLVFVCYQANLADGFIFVQNLLNGEPLEEYISPFGGGYFFVLPGVEKGGFLGQGLLGV

SEQ ID NO: 2565 - DNA, 1266 bp, Neisseria meningitidis
atgagcaaaaaccaacccgcacaaccgaccaggcgcactctttttaaaaccgcgatcgcagctggagcagtcggcgcaatcggaggttatctcggcggcaaaaaacggggcgaaaccgccgaacgcaccgccgaaagccaacactcgccccaagcctatccctgctacggcgaacatcaggcaggcatcgttacgccgcagcaggcgttttcgattatgtgcgccttcgacgtaaccgcgcaaagtgccaagcagctggaaaacctgttccgcacgctgaccgcccgcatcgagtttctcacccaaggcggcgaataccaagacggcgacgacaaacttccgccagccggcagcggcattttgggcaaagccttcaaccccgacgggttgaccgttaccgtgggggtgggcagcagcctgtttgacggccggttcggactcaaagacaaaaaaccgattcatttgcaggaaatgcgcgacttctccaacgataagctgcaaaaaagctggtgcgacggcgatttgagcctgcaaatctgtgccttcacccccgaaacctgccaagccgccctgcgcgacatcatcaaacacaccgtccaaaccgccgttatccgctggagtatcgacgggtggcagcctaaatccgaacccggcgcgatggcggcgcgcaacctgttgggcttccgcgacggcacgggcaaccccaaagtttccgaccccaaaactgccgacgaggttttgtggacgggggtggccgccaacagcctcgacgaaccggagtgggcgaaaaacggcagctatcaggcagtccgccttatccgccactttgttgagttttgggacaggacgccgcttcaagagcaaaccgacattttcgggcggcgcaaatacagcggcgcgccgatggacggcaaaaaagaagccgaccaaccggattttgccaaagaccccgaggggaataccacgcccaaagacagccatatacgcctggcgaatccgcgcgatcccgagttccttaaaaaacaccgcctcttccgccgcgcctacagctattcgcgcggactcgcctcaagcggacagcttgatgtcgggctggtgttcgtctgctatcaggcaaaccttgccgacggattcatcttcgtgcaaaacctcctcaacggcgaaccgctggaagaatacatcagccccttcggcggcggctatttcttcgtcttgcccggcgtggaaaaaggcggctttttggggcaagggctgctgggcgtataa

SEQ ID NO: 2566 - protein, 421 aa, Neisseria meningitidis
MSKNQPAQPTRRTLFKTAIAAGAVGAIGGYLGGKKRGETAERTAESQHSPQAYPCYGEHQAGIVTPQQAFSIMCAFDVTAQSAKQLENLFRTLTARIEFLTQGGEYQDGDDKLPPAGSGILGKAFNPDGLTVTVGVGSSLFDGRFGLKDKKPIHLQEMRDFSNDKLQKSWCDGDLSLQICAFTPETCQAALRDIIKHTVQTAVIRWSIDGWQPKSEPGAMAARNLLGFRDGTGNPKVSDPKTADEVLWTGVAANSLDEPEWAKNGSYQAVRLIRHFVEFWDRTPLQEQTDIFGRRKYSGAPMDGKKEADQPDFAKDPEGNTTPKDSHIRLANPRDPEFLKKHRLFRRAYSYSRGLASSGQLDVGLVFVCYQANLADGFIFVQNLLNGEPLEEYISPFGGGYFFVLPGVEKGGFLGQGLLGV

SEQ ID NO: 2567 - DNA, 1167 bp, Neisseria gonorrhoeae
atgagaaaattcaatttgaccgcattgtccgtgatgcttgccttgggtttgaccgcgtgccagccgccggaggcggagaaagccgcgccggccgcgtccggtgagacccaatccgccaacgaaggcggttcggtcggtatcgccgtcaacgacaatgcctgcgaaccgatgaatctgaccgtgccgagcggacaggttgtgttcaatattaaaaacaacagcggccgcaagctcgaatgggaaatcctgaagggcgtgatggtggtggacgaacgcgaaaatatcgccccggggctttccgacaaaatgaccgtaaccctgctgccgggcgaatacgaaatgacctgcggccttttgaccaatccgcgcggcaagctggtggtagccgacagcggctttaaagacaccgccaacgaagcggatttggaaaaactgccccaaccgctcgccgactataaagcctacgttcaaggcgaggttaaagagctggcggcgaaaaccaaaacctttaccgaagccgtcaaagcaggcgacattgaaaaggcgaaatccctgtttgccgccacccgcgtccattacgaacgcatcgaaccgattgccgagcttttcagcgaactcgaccccgtcatcgatgcgtgtgaagacgacttcaaagacggtgcgaaagatgccgggtttaccggcttccaccgtatcgaacacgccctttgggtggaaaaagacgtatccggcgtgaaggaaaccgcggccaaactgatgaccgatgtcgaagccctgcaaaaagaaatcgacgcattggcgttccctccgggcaaagtggtcggcggcgcgtccgaactgattgaagaagcggcgggcagtaaaatcagcggcgaagaagaccgttacagccacaccgatttgagcgacttccaagctaatgcggacggatctaaaaaaatcgtcgatttgttccgtccgttgattgaggccaaaaacaaagccttgttggaaaaaaccgataccaacttcaaacaggtcaacgaaattctggcgaaataccgcaccaaagacggttttgaaacctacgacaagctgagcgaagccgaccgcaaagcattacaggctcctattaacgcgcttgccgaagaccttgcccaacttcgcggcatactcggcttgaaataa

SEQ ID NO: 2568 - protein, 388 aa, Neisseria gonorrhoeae
MRKFNLTALSVMLALGLTACQPPEAEKAAPAASGETQSANEGGSVGIAVNDNACEPMNLTVPSGQVVFNIKNNSGRKLEWEILKGVMVVDERENIAPGLSDKMTVTLLPGEYEMTCGLLTNPRGKLVVADSGFKDTANEADLEKLPQPLADYKAYVQGEVKELAAKTKTFTEAVKAGDIEKAKSLFAATRVHYERIEPIAELFSELDPVIDACEDDFKDGAKDAGFTGFHRIEHALWVEKDVSGVKETAAKLMTDVEALQKEIDALAFPPGKVVGGASELIEEAAGSKISGEEDRYSHTDLSDFQANADGSKKIVDLFRPLIEAKNKALLEKTDTNFKQVNEILAKYRTKDGFETYDKLSEADRKALQAPINALAEDLAQLRGILGLK

SEQ ID NO: 2569 - DNA, 1167 bp, Neisseria meningitidis; identical to SEQ ID NO: 1867

SEQ ID NO: 2570 - protein, 388 aa, Neisseria meningitidis; identical to SEQ ID NO: 1868

SEQ ID NO: 2571 - DNA, 1167 bp, Neisseria meningitidis; identical to SEQ ID NO: 1869

SEQ ID NO: 2572 - protein, 388 aa, Neisseria meningitidis; identical to SEQ ID NO: 1870

SEQ ID NO: 2573 - DNA, 972 bp, Neisseria gonorrhoeae
gtgaaaccgcgtttttattgggcagcctgcgccgtcctgccggccgcctgttcgcccgaacctgccgccgaaaaaactgtatccgccgcatcccaagccgcatccacacctgtcgccacgctgaccgtgccgaccgcgcggggcgatgccgttgtgccgaagaatcccgaacgcgtcgccgtgtacgactgggcggcgttggatacgctgaccgagccgggcgtgaatgtgggcgcaaccaccgcgccggtgcgcgtggactatttgcagcctgcatttgacaaggcggcaacggtggggacgctgtttgagcccgattgcgaatccctgcaccgccacaatccgcagtttgtcattaccggcgggccgggtgcggaagcgtatgaacagttggcgaaaaacgcgaccaccatagatttgacggtggacaacggcaatatccgcaccagcggcgagaagcagatggagaccctgtcgcggattttcggtaaggaagcgcgcgtggcggaattgaatgcgcagattgacgcgctgttcgcccaaaagcgcgaagccgccaaaggcaaaggacgcgggctggtgctgtcggttacaggcaacaaggtgtccgccttcggcacgcaatcgcggttggcaagttggatacacggcgacatcggcctgccgcccgtggacgaatctttacgcaacgaagggcacgggcagcccgtttccttcgaatacatcaaagagaaaaaccccggctggattttcatcatcgaccgcaccgccgccatcgggcaggaagggccggctgccgtggaagtgttggataacgcgctggtatgcggcacgaacgcttggaagcgcaagcaaatcatcgtcatgcctgccgcgaactacattgtcgcgggcggcgcgcggcagttgatacaggcggcggaacagttgaaggcggcgtttgaaaaggcagaacccgttgcggcgcagtag

SEQ ID NO: 2574 - protein, 323 aa, Neisseria gonorrhoeae
VKPRFYWAACAVLPAACSPEPAAEKTVSAASQAASTPVATLTVPTARGDAVVPKNPERVAVYDWAALDTLTEPGVNVGATTAPVRVDYLQPAFDKAATVGTLFEPDCESLHRHNPQFVITGGPGAEAYEQLAKNATTIDLTVDNGNIRTSGEKQMETLSRIFGKEARVAELNAQIDALFAQKREAAKGKGRGLVLSVTGNKVSAFGTQSRLASWIHGDIGLPPVDESLRNEGHGQPVSFEYIKEKNPGWIFIIDRTAAIGQEGPAAVEVLDNALVCGTNAWKRKQIIVMPAANYIVAGGARQLIQAAEQLKAAFEKAEPVAAQ

SEQ ID NO: 2575 - DNA, 966 bp, Neisseria meningitidis
gtgaaaccgcgtttttattgggcagcctgcgccgtcctgctgaccgcctgttcgcccgaacctgccgccgaaaaaactgtatccgccgcatccgcatctgccgccacgctgaccgtgccgaccgcgcggggcgatgccgttgtgccgaagaatcccgaacgcgtcgccgtgtacgactgggcggcgttggatacgctgaccgaattgggcgtgaatgtgggcgcaaccaccgcgccggtgcgcgtggattatttgcagcctgcatttgacaaggcggcaacggtggggacgctgttcgagcccgattacgaagccctgcaccgctacaatcctcagcttgtcattaccggcgggccgggcgcggaagcgtatgaacagttagcgaaaaacgcgaccaccatagatctgacggtggacaacggcaatatccgcaccagcggcgaaaagcagatggagaccttggcgcggattttcggcaaggaagcgcgcgcggcggaattgaaggcgcagattgacgcgctgttcgcccaaacgcgcgaagccgccaaaggcaaaggacgcgggctggtgctgtcggttacgggcaacaaggtgtccgccttcggcacgcagtcgcggttggcaagttggatacacggcgacatcggcctaccgcctgtagacgaatctttacgcaacgaggggcacgggcagcctgtttccttcgaatacatcaaagagaaaaaccccgattggattttcatcatcgaccgtaccgccgccatcgggcaggaagggccggcggctgtcgaagtattggataacgcgctggtacgcggcacgaacgcttggaagcgcaagcaaatcatcgtcatgcctgccgcgaactacattgtcgcgggcggcgcgcggcagttgattcaggcggcggagcagttgaaggcggcgtttaaaaaggcagaacccgttgcggcggggaaaaagtag

SEQ ID NO: 2576 - protein, 321 aa, Neisseria meningitidis
VKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGARQLIQAAEQLKAAFKKAEPVAAGKK

SEQ ID NO: 2577 - DNA, 966 bp, Neisseria meningitidis
gtgaaaccgcgtttttattgggcagcctgcgccgtcctgctgaccgcctgttcgcccgaacctgccgccgaaaaaactgtatccgccgcatccgcatctgccgccacactgaccgtgccgaccgcgcggggcgatgccgttgtgccgaagaatcccgaacgcgtcgccgtgtacgactgggcggcgttggatacgctgaccgaattgggtgtgaatgtgggcgcaaccaccgcgccggtgcgcgtggattatttgcagcctgcatttgacaaggcggcaacggtggggacgctgttcgagcccgattacgaagccctgcaccgctacaatcctcagcttgtcattaccggcgggccgggcgcggaagcgtatgaacagttggcgaaaaacgcgaccaccatagatctgacggtggacaacggcaatatccgcaccagcggcgaaaagcagatggagaccttggcgcggattttcggcaaggaagcgcgcgcggcggaattgaaggcgcagattgacgcgctgttcgcccaaacgcgcgaagccgccaaaggcaaaggacgcgggctggtgctgtcggttacgggcaacaaggtgtccgccttcggcacgcagtcgcggttggcaagttggatacacggcgacatcggcctaccgcctgtagacgaatctttacgcaacgaggggcacgggcagcctgtttccttcgaatacatcaaagagaaaaaccccgattggattttcatcatcgaccgtaccgccgccatcgggcaggaagggccggcggctgtcgaagtattggataacgcgctggtacgcggcacgaacgcttggaagcgcaagcaaatcatcgtcatgcctgccgcgaactacattgtcgcgggcggctcgcggcagttgattcaggcggcggagcagttgaaggaggcgtttgaaaaggcagaacccgttgcggcggggaaagagtag

SEQ ID NO: 2578 - protein, 321 aa, Neisseria meningitidis
VKPRFYWAACAVLLTACSPEPAAEKTVSAASASAATLTVPTARGDAVVPKNPERVAVYDWAALDTLTELGVNVGATTAPVRVDYLQPAFDKAATVGTLFEPDYEALHRYNPQLVITGGPGAEAYEQLAKNATTIDLTVDNGNIRTSGEKQMETLARIFGKEARAAELKAQIDALFAQTREAAKGKGRGLVLSVTGNKVSAFGTQSRLASWIHGDIGLPPVDESLRNEGHGQPVSFEYIKEKNPDWIFIIDRTAAIGQEGPAAVEVLDNALVRGTNAWKRKQIIVMPAANYIVAGGSRQLIQAAEQLKEAFEKAEPVAAGKE

SEQ ID NO: 2579 - DNA, 1014 bp, Neisseria meningitidis
atggcttggagtatgtttgccacaacccaagccgatagagcggtaaggtctgcaactgcacctaaagaaatgtggttccataagaagataatagatgaaaaaacaggtaaagtatcctttgataccagacaaatttggtcattgaatgatttaagcaaggaagaactggcaagcattcaagacacaaatggcaaagttattactgtgtctaatcctggtattttcaataatcgagaagattcattaagcaacgcagcaaaacaaaatcgtaatagtacaaacggtagtggtgttattgcagtcatgaatcctccaacagggaaatataaatctgattctaataacaaaataaaagattttttatggctcggttcaagtcttgtttctgaactgatgtatgtcggttacgaccaattaaataataaagtgttccaaggctatttacccaaaaccaattcagaaaaactgaatcaagatatttatcgagaggttcaaaaaatgggtaacggctggtcggttgataccagtaatcacagtcgtgggggaattacagcaagcgtttccttaaaagattgggtaaacaatcaaaaacaaaatggcattgccccaatcagaaaagcacgtttctatggtacagccacaaatgtgcagaatgattacgccgatgttttacagaaaaacggctatacctatacgggtgcagacggcaaaacttataacagcggatcctactcaatcgtgcatgataaagattttgtggggaacaaatggatacctttcttgctaggaaccaatgacaccacacaaggtacatgtaaggggttgtgctattcgcatagcagttattttgcggaggtgccaaaagcaggtacaaaagaatttgatgactatgtaaaaatatggggtgaagttgaatatgacgctcaaggtaagccaattaacaaatctaaacccatactggtagaaccaaacaaaacaaaagataatgaaaaatatgaaaaagaagctttctaa

SEQ ID NO: 2580 - protein, 337 aa, Neisseria meningitidis
MAWSMFATTQADRAVRSATAPKEMWFHKKIIDEKTGKVSFDTRQIWSLNDLSKEELASIQDTNGKVITVSNPGIFNNREDSLSNAAKQNRNSTNGSGVIAVMNPPTGKYKSDSNNKIKDFLWLGSSLVSELMYVGYDQLNNKVFQGYLPKTNSEKLNQDIYREVQKMGNGWSVDTSNHSRGGITASVSLKDWVNNQKQNGIAPIRKARFYGTATNVQNDYADVLQKNGYTYTGADGKTYNSGSYSIVHDKDFVGNKWIPFLLGTNDTTQGTCKGLCYSHSSYFAEVPKAGTKEFDDYVKIWGEVEYDAQGKPINKSKPILVEPNKTKDNEKYEKEAF

SEQ ID NO: 2581 - DNA, 1413 bp, Neisseria meningitidis
atgaaaatttccagacctccggaatttaccctgttgcaacaggaatatatgcagcatctcactgaaagaatgacgcaaattgccaagctgctgaattcttccgcaaacaatcctgatatagacattcccgattttcttactgaaatcaaagattattcagaattttccgtgacagatgaaaatggaacctacctgcattgggacaaattccgccggattcacacggaagatacgcggatgaaatggcgcgccgttaaggaaagccgcaaaaaaatccaaaaaccaattgatttcccgtttgaacatcagttttggttctgcattcccgactctttgcaggcacggcttcatttgattgacaaaagctgcggcagttctatcggcacgtctagcttgggtggcttcggcagaagcgagcaaaacagattcttgctcaagtctctgattatggaagaagcgattacatccgcccaactggaaggtgcggctaccacgcgtaaagtggccaaggatatgctcaaatcgcagcgtaaacccaaaacaaaagacgaaatcatgatagtgaacaactatcacttgatgaaaaaagcggtagaattgaaaaatacgccgttaagtgttgaaatgattttggatttgcaccgcattgctaccagtaacgctattgaaaacaaggccgagcccggacaattcaggcaggatgacgaaatctttatcgccgatatcaatggtaacagcctgtatcaaccaccgccgcacggacaggttcatacgctgatggaagaggtgtgtgcgtttgccaataatacctatgacggcgtggaaaatccgtttatccatccggttgtccaagctattatcttgcatttcctcatcggctacatccacccatttggtgatggcaacgggcggacagcgcgggctttgttctattggtttatgctcaaaaacggctactggctatttgaatacatatccatcagccgtcttctgaaaaacgctcctgcccaatacgccaaatcctatttgtatgcggaaactgacgatttagatttaacctatttcatctattaccaatgcgatattatcaagcgggcggttgccgatttggagcactacatttccgacaaacaaaaacaccaacaggaattcaaagcagcgattgcccaatatactgaaaagataggaaagttgaaccaacggcaaattggtatcctgcaaaaagcagtggaagaaagcggaaaaatctttactgcacaagaaattgccaaccaatacggcatctccctgaatactgcccgtagcgatttgagtaaactgggagaatatagattcctagtgccgttcaaatcaggaaatgctttagagtatgttgctcctcaggatttattggaaaggttagaaaaaaaatag

SEQ ID NO: 2582 - protein, 470 aa, Neisseria meningitidis
MKISRPPEFTLLQQEYMQHLTERMTQIAKLLNSSANNPDIDIPDFLTEIKDYSEFSVTDENGTYLHWDKFRRIHTEDTRMKWRAVKESRKKIQKPIDFPFEHQFWFCIPDSLQARLHLIDKSCGSSIGTSSLGGFGRSEQNRFLLKSLIMEEAITSAQLEGAATTRKVAKDMLKSQRKPKTKDEIMIVNNYHLMKKAVELKNTPLSVEMILDLHRIATSNAIENKAEPGQFRQDDEIFIADINGNSLYQPPPHGQVHTLMEEVCAFANNTYDGVENPFIHPVVQAIILHFLIGYIHPFGDGNGRTARALFYWFMLKNGYWLFEYISISRLLKNAPAQYAKSYLYAETDDLDLTYFIYYQCDIIKRAVADLEHYISDKQKHQQEFKAAIAQYTEKIGKLNQRQIGILQKAVEESGKIFTAQEIANQYGISLNTARSDLSKLGEYRFLVPFKSGNALEYVAPQDLLERLEKK

SEQ ID NO: 2583 - DNA, 1413 bp, Neisseria meningitidis; identical to SEQ ID NO: 2581

SEQ ID NO: 2584 - protein, 470 aa, Neisseria meningitidis; identical to SEQ ID NO: 2582

SEQ ID NO: 2585 - DNA, 459 bp, Neisseria meningitidis
atgcccatcactccacccttaaacatcatctctcctaaactctaccccaatgaacaatggaacgaaagcgaagcactcggtgccatcacttggctatggtatcagtcgcctacgcatcgccaagtacctattgtggagatgatgacgtatatattgcctgtgttaaaaaacgggcagttcgctttgttttgcaagggtacccaaccaatcggttatatctcatgggcttattttgatgaagtggcgcaggcgcattatttagaatctgaccgccatttgcgtgacaacagcgattggaactgtggcgacaatatttggctgattcaatggtttgcgccattgggacacagtcatcaaatgcgctcagctgtgcgccagttatttcctagtacgacagtacgcgccttgtatcataaagggagcgataagggtttgagaattttaacttttaaaacttga

SEQ ID NO: 2586 - protein, 152 aa, Neisseria meningitidis
MPITPPLNIISPKLYPNEQWNESEALGAITWLWYQSPTHRQVPIVEMMTYILPVLKNGQFALFCKGTQPIGYISWAYFDEVAQAHYLESDRHLRDNSDWNCGDNIWLIQWFAPLGHSHQMRSAVRQLFPSTTVRALYHKGSDKGLRILTFKT

SEQ ID NO: 2587 - DNA, 1290 bp, Neisseria meningitidis
atgatgaagtctatcctcaccgtatccggaaatcgtatgcgtaaacccagaatcacctatttggatgtttgggcaaacgatgaaagaatcggtactttggaaaagggggccatgtatcggttcgcatacgacaatcccaattcttcgttgctgggcctgcattatcaagacagaagcaaggtatatatcagcaacaatatgccgcatatctttgcacagtattttccggaaggctttttggatgcacacatcacaagcaaatatgcttttcatgatgcgccttttgaagacaatgagatgctgcgcttggcaattctgtgcagagagactttgggtcggatacatgtgcgctgtaatgacccgctttttaatgaatggattgacgggttggagatgaaaaatccaagaatattgactgaacgggatttgctgggcataaatgcccgacaggtttttcagcaatatatggcagaaatcttccatcacggccgtttcgtcagtgtatccgggatacagcagaagatgtccttagatgccatccgcagaaataccaagcaaactgcctcatatattgccaaaggttttgatgcatccgaatatccttgcttggctgccaatgaatttttatgcatgcagaccatcaaacaagccggcattgccgttgcacagaccagcctgtcggaagattcatcagtcttattggtacgtcggtttgatgtcagtgaacagggttattttttagggatggaagactttaccagtctgcgccagtattcggtagaagataaatataaaggcagttatgcggctattgcacagattatccgacagatatccggcagaccagatgaagatttaatccatttctttaatcagcttgctgccagttgcatattgaaaaacggcgatgcacacctcaaaaatttttcagtactctatcatgacgaatacgatgttcgtcttgcacctgtctatgatgtattggatacatcaatatacagggttggaacacaaggaatttttgatgcttatgacgatacgctggcattaaacctgactaaccacggtaagaaaacatatccttccaagaatacattgttggattttgctgagaaatattgcgatttgggaagagaagatgcatcctttatgatagatacaatcgttcaagctaaagaacaggttcttgttaaatactcggatgtattgcgtgagaatgaatggttggcgcagaagtggcattttatcccggatgaaaatgaagaaggtctaccgtttacattccggtag

SEQ ID NO: 2588 - protein, 429 aa, Neisseria meningitidis
MMKSILTVSGNRMRKPRITYLDVWANDERIGTLEKGAMYRFAYDNPNSSLLGLHYQDRSKVYISNNMPHIFAQYFPEGFLDAHITSKYAFHDAPFEDNEMLRLAILCRETLGRIHVRCNDPLFNEWIDGLEMKNPRILTERDLLGINARQVFQQYMAEIFHHGRFVSVSGIQQKMSLDAIRRNTKQTASYIAKGFDASEYPCLAANEFLCMQTIKQAGIAVAQTSLSEDSSVLLVRRFDVSEQGYFLGMEDFTSLRQYSVEDKYKGSYAAIAQIIRQISGRPDEDLIHFFNQLAASCILKNGDAHLKNFSVLYHDEYDVRLAPVYDVLDTSIYRVGTQGIFDAYDDTLALNLTNHGKKTYPSKNTLLDFAEKYCDLGREDASFMIDTIVQAKEQVLVKYSDVLRENEWLAQKWHFIPDENEEGLPFTFR

SEQ ID NO: 2589 - DNA, 438 bp, Neisseria meningitidis
atgagccgttacctgattacctttgatatggataccaactgcctgaaagacaattaccacggaaataactataccaatgcctactccgatattaaaaccatcttggctagacatggatttgagaacattcagggcagtgtttatctaggccgtgaaggcatcagtgaagcacacggaacaatagccattcaggaactgaccgctcggtttgattggttttactcctgtatttcaaacattaagttttaccgccttgaaagtgatttgaacgcacaatttatcgctgatggtgtgtatcaagccaaacaggctttccttcaacgtgttgaacaacttcgtatatccctaacagaagctggattgtctgatgagcaaatcaatcaggttctggaaaaacagaaatttgaattggaaagtcctaacctgaaattaaattaa

SEQ ID NO: 2590 - protein, 145 aa, Neisseria meningitidis
MSRYLITFDMDTNCLKDNYHGNNYTNAYSDIKTILARHGFENIQGSVYLGREGISEAHGTIAIQELTARFDWFYSCISNIKFYRLESDLNAQFIADGVYQAKQAFLQRVEQLRISLTEAGLSDEQINQVLEKQKFELESPNLKLN

SEQ ID NO: 2591 - DNA, 561 bp, Neisseria meningitidis
atgaccgccaactttgcacagacgctggtcgaaatacaggacagtctgtacagggttgtgtcaaccgtccaatacggggatgacaacctcaagcggttgacagcggacaaacggaagcagtatgagttgaacttcaagatttccgagggttctacgcgtgtagagtccgactttaaagagactttggttcggttcggtagagatatgcttcaagatatgccccctaaaatccgttcggcaacgctggtagcgttgacgaccctgcttgtcggaggggcgttgggttacggttatttggaatacctgaagcaggttgcttcggaagggtatcagaccgagcgtctgtataatgccgtcgaccgtcttgcagaatcccaagaacggataacgtccgccatcctgaagggtgctagaggtgccgatttcgtgcaaatcggcagacgttcctacagtagggaggatatatcggaggcaaatagacgtgcagagcgtgtcccgtatggcgcagagttggtttcagacggcaattttaccgctgttttatctgatataggggattaa

SEQ ID NO: 2592 - protein, 186 aa, Neisseria meningitidis
MTANFAQTLVEIQDSLYRVVSTVQYGDDNLKRLTADKRKQYELNFKISEGSTRVESDFKETLVRFGRDMLQDMPPKIRSATLVALTTLLVGGALGYGYLEYLKQVASEGYQTERLYNAVDRLAESQERITSAILKGARGADFVQIGRRSYSREDISEANRRAERVPYGAELVSDGNFTAVLSDIGD

SEQ ID NO: 2593 - DNA, 561 bp, Neisseria meningitidis
  misc_feature (51)..(51): n is a, c, g, or t
atgaccgccaactttgcacagacgctggtcgaaatacaggacagtctgtanagggttgtgtcaaccgtccaatacggggatgacaacctcaagcggttgacagcggacaaacggaagcagtatgagttgaacttcaagatttccgagggttctacgcgtgtagagtccgactttaaagagactttggttcggttcggtagagatatgcttcaagatatgccccctaaaatccgttcggcaacgctggtagcgttgacgaccctgcttgtcggaggggcgttgggttacggttatttggaatacctgaagcaggttgcttcggaagggtatcagaccgagcgtctgtataatgccgtcgaccgtcttgcagaatcccaagaacggataacgtccgccatcctgaagggtgctagaggtgccgatttcgtgcaaatcggcagacgttcctacagtagggaggatatatcggaggcaaatagacgtgcagagcgtgtcccgtatggcgcagagttggtttcagacggcaattttaccgctgttttatctgatataggggattaa

SEQ ID NO: 2594 - protein, 186 aa, Neisseria meningitidis
  misc_feature (17)..(17): Xaa can be any naturally occurring amino acid
MTANFAQTLVEIQDSLXRVVSTVQYGDDNLKRLTADKRKQYELNFKISEGSTRVESDFKETLVRFGRDMLQDMPPKIRSATLVALTTLLVGGALGYGYLEYLKQVASEGYQTERLYNAVDRLAESQERITSAILKGARGADFVQIGRRSYSREDISEANRRAERVPYGAELVSDGNFTAVLSDIGD

SEQ ID NO: 2595 - DNA, 564 bp, Neisseria meningitidis
atgaaaatactcgctttattaattgccgctacctgtgctttatctgcgtgtggcagccaatctgaagaacaaccggcatctgcacaaccccaagagcaggcacaatccgaattaaaaaccatgccggtaagctataccgactatcaatcagcagccaataaagggctgaatgaccaaaaaaccggtctgacccttcctgaacatgttgtccctatcgacaatgcggaaggaaagaatctgctgcatgacttttcagacggcctcacaatcttaaccgttgataccgataaagccgacaaaattactgctgtccgagtagtctggaatacagatgcaatgcctcaaaaagcggaaaaactgtccaaagctgccgcagccttgattgcggcaaccgctccggaagaccgcacaatgctgcgtgataccggcgaccaaatcgaaatggcgattgacagccataatgcgcaaaaagagccaacccgagaatgggcgcgtggtgggattgcttataaagtcactgttaccaatttaccgagcgtggttttgacggcaaaagctgagtaa

SEQ ID NO: 2596 - protein, 187 aa, Neisseria meningitidis
MKILALLIAATCALSACGSQSEEQPASAQPQEQAQSELKTMPVSYTDYQSAANKGLNDQKTGLTLPEHVVPIDNAEGKNLLHDFSDGLTILTVDTDKADKITAVRVVWNTDAMPQKAEKLSKAAAALIAATAPEDRTMLRDTGDQIEMAIDSHNAQKEPTREWARGGIAYKVTVTNLPSVVLTAKAE

SEQ ID NO: 2597 - DNA, 504 bp, Neisseria meningitidis
atgaacaatctgaccgtgtttacccgtttcgataccgatttggcgacgcttgccgatgaattgcaatatgtgtgggaacacaccgccgttacagaccatcagggcaaactggtggaaattcccgtctgctacggcggcgaatacggcccggatttggcggaagtcgctgctttccatcagacggttatttccgaaatcgtccgccgccatacggcgcaaacttataccgtatttatgatgggcttccagcccggtttcccttatctgggcggcttgcccgaagcattgcacacgccccgccgtgccgtgccgagaacgtccgttcctgccggttcggtcggtatcggcggcagtcagaccggtgtgtatccgttcgcttcgcccggcggctggcagattatcggcagaaccgaattacccttgttccgagccgatttgaatccgccgaccctgctggcggcgggtgaccaagtccgctttgttgcagaaaggattgagccatga

SEQ ID NO: 2598 - protein, 167 aa, Neisseria meningitidis
MNNLTVFTRFDTDLATLADELQYVWEHTAVTDHQGKLVEIPVCYGGEYGPDLAEVAAFHQTVISEIVRRHTAQTYTVFMMGFQPGFPYLGGLPEALHTPRRAVPRTSVPAGSVGIGGSQTGVYPFASPGGWQIIGRTELPLFRADLNPPTLLAAGDQVRFVAERIEP

SEQ ID NO: 2599 - DNA, 504 bp, Neisseria meningitidis
atgaacaatctgaccgtgttcacccgtttcgataccgatttggcgacgcttgccgatgaattgcaatatgtgtgggaacacaccgccgttacagaccatcagggcaaactggtggaaattcccgtctgctacggcggcgaatacggcccggatttggcggaagtcgctgctttccatcagacggttatttccgaaatcgtccgccgccatacggcgcaaacttataccgtatttatgatgggcttccagcctggtttcccttatctgggcggcttgcccgaagcattgcacacgccccgccgtgccgtgccgagaacgtccgttcctgccggttcggtcggtatcggcggcagtcagaccggtgtgtatccgttcgcttcgcccggcggctggcagattatcggcagaaccgaattacccttgttccgagccgatttgaatccgccgaccctgctggcggcgggtgaccaagtccgctttgttgcagaaaggattgagccatga

SEQ ID NO: 2600 - protein, 167 aa, Neisseria meningitidis; identical to SEQ ID NO: 2598

SEQ ID NO: 2601 - DNA, 4296 bp, Neisseria meningitidis
atgcgcttcacacacaccaccccattttgttccgtattgtccaccctcggtctttttgccgtttcccctgcttactcatccattgtccgcaacgatgtcgattaccaatattttcgcgactttgccgaaaataaaggcgcgttcaccgtaggtgcaagcaatatttccatccaagacaagcaaggcaaaatattaggcagggttctcaacggcatccccatgcccgacttccgcgtcagcaaccgccaaaccgccatcgccaccctggttcacccccaatacgtcaacagtgtcaaacacaacgtcggctacggttccatacaattcggcaacgacacccaaaatccagaagaacaagcctatacctaccgcctcgtatcacgcaacccgcacccggactacgactaccaccttccccgcctcaacaaactggttaccgaaatctcacctaccgcactcagcagcgtacccttgcttggaaacggccagccaaaggccaatgcctacctcgataccgaccgcttcccctactttgtacgactcggctcaggcacgcaacaagtccgcaaagcagacggcacgcgtacacgaaccgccccggcataccaatacctgaccggcggcacgccgctgaaagtattggggttccaaaaccacggcttactcgtcggcggcagcctgaccgaccaaccccttaacacctacgcaatcgccggagacagcggttcccccctgtttgccttcgacaagcatgaaaaccgctgggtgcttgcgggcgtactcagcacctacgccggcttcgataatttcttcaacaaatacatcgtcacgcaacccgaattcatccgttccaccatccgccaatacgaaacccggctggatgtcgggctgaccaccaacgaactcatatggcgcgacaacggtaatggcaacagcaccctgcaagggctcaacgaacgcatcaccctgcccattgcaaacccttcgcttgccccacaaaacgacagcaggcacatgccgtctgaagatgccggcaaaacgctcatcctatccagcaggttcgacaacaaaacactgatgctggcagacaatatcaaccaaggcgcaggcgcattgcagttcgacagcaacttcaccgtcgtcggtaaaaaccacacatggcaaggtgcaggcgttatcgtagccgacggcaaacgcgtcttctggcaagtcagcaaccccaaaggcgaccggctctccaaactgggcgcaggcacgcttatcgccaacggacaaggcatcaaccagggcgacatcagcatcggggaaggcactgtcgtactcgcccaaaaagctgcttcagacggcagcaaacaagcattcaaccaagtcggcatcaccagcggcaggggcacggccgtcctcgccgacagccagcaaatcaaacccgaaaacctctatttcggcttcaggggcggacggctcgacctcaacggcaacaaccttgcctttacccatatccgccatgcggacggcggcgcgcaaatcgtcaatcacaaccctgaccaagccgcgacactgacgctgaccggcaaccccgtcctcagtcccgagcatgtcgagtgggtgcaatggggcaaccgtccgcaaggcaacgcggcggtttacgaatacatcaacccgcaccgcaaccgtcggaccgactacttcatactcaaacccggcggcaacccgcgcgaatttttcccgttaaatatgaaaaactcaacaagctggcaatttatcggcaacaacaggcaacaggccgccgaacaagtcgcccaagccgaaaatgcccgccccgacctgattaccttcggcggatacttgggtgaaaacgcgcaaacgggcaaagccgcgccgagttacagcaaaaccaatgaagcagccatagaaaaaacccgccatatcgcaaatgccgccgtatacggccggcccgaataccgttacaacggcgcactcaacctgcactatcgtcccaaacgcaccgacagcacgctgttgctcaacggcggcatgaaccttaacggggaagtcttgattgagggcggcaatatgattgtgtcaggcaggcccgtaccccatgcctacgaccaccaggccaaacgcgaacccgttcttgaaaacgaatggaccgacggcagcttcaaggctgcacggttcaccctgcgaaaccatgcccgactgacggcagggcgcaataccgcgcatctggacggcgacataaccgcatacgatctgtccggcatcgacctcggctttacccaaggcaaaacaccggaatgctaccgctcctaccatagcggcagcacccactgcacacccaacgccgttttaaaagccgaaaactatcgtgcactacctgcaacgcaagtacgcggcgacattacccttaacgaccgttcagagctccgcctgggcaaagcacacctgtacggcagcatccgtgccggcaaagacaccgcagtccgcatggaagcagacagcaactggacactttcccagtccagccacaccggcgcactgacgcttgacggcgcacaaattaccctgaaccccgatttcgccaataatacacacaacaaccgcttcaacacactgaccgtcaacggcacacttgacgggttcggcacattccgattcctgaccggcatcgtccgaaaacaaaatgccccccccctcaaactggaaggggacagccgcggcgcattccaaatccacgtcaaaaacaccggacaagaacctcaaacaaccgaatcgcttgcacttgtgagcctcaatccgaaacacagccaccaagcccgattcaccctccaaaacggctatgccgatttgggtgcctaccgctacatcctccgcaaaaacaacaacggatacagcctgtacaacccgctcaaagaggccgaacttcaaattgaagccacgcgtgcggaacatgagcgcaaccaacaggcatacaaccaattacaggcaaccgacatcagcagacaggttcaacatgactctgacgcgaccaggcaggcactacaggcctggcagaacagtcaaaccgaacttgcccgcatcgacagccaagtccaatatctgtccgcccaattgaaacagacagacccgctgaccggcattctgacgcgtgcccaaaacctgtgtgccgcacaaggatacagtgccgatatctgccgtcaggttgccaaagccgccgacacgaacgacctgacactcttcgaaaccgaactggatacgtatatagaacgtgtagaaatggccgaatccgaacttgacaaagcacggcaaggcggcgatgcgcaagccgtcgaaacagcccggcacgcctacctgaacgcactcaaccgtctgtcccgacaaatccacagtttgaaaaccggcgttgccggcatccgtatgccgaacctggccgaactgatcagccggtcggccaacaccgccgtttccgaacaggccgcctacaataccggccggcaacaggcgggacgccgcatcgaccgccaccttaccgatccgcagcagcaaaacatctggctggaaaccggtacgcaacaaaccgactaccatagcggcacacaccgtccctaccaacaaactaccaactatgcacatatcggcatccaaaccggcatcaccgaccgtctcagtgtcggtacgattttaaccgatgagcgcacaaacaaccgttttgatgaaggcgtatccgcccgaaaccgcagcaacggcgcacatctgttcgtcaaaggggaaaacggcgcactctttgccgcggcagatttaggctacagcaacagccgtacccgatttaccgattatgacggggctgccgtccgccgccacgcatgggatgcaggcatcaacaccggcatcaaaatcgataccggcatcaacctcagaccctatgccggcatccgtataaaccgcagcaacggcaaccggtacgtactcgacggcgcagagataaacagcccggcgcaaatccaaaccacatggcatgccggcatccgtctcgataaaaccgtcgaactgggtcaagccaagctgacccccgccttcagcagcgattactaccatacccgccaaaacagcggttccgccctcagcgtcaacgaccgtaccttactgcagcaagccgcccacggcacactgcataccctgcaaatcgacgccggatacaaaggctggaacgccaaacttcatgccgcttacggcaaagacagcaacaccgcccgccacaaacaggcaggaatcaaaataggctacaactggtaa

SEQ ID NO: 2602 - protein, 1431 aa, Neisseria meningitidis
MRFTHTTPFCSVLSTLGLFAVSPAYSSIVRNDVDYQYFRDFAENKGAFTVGASNISIQDKQGKILGRVLNGIPMPDFRVSNRQTAIATLVHPQYVNSVKHNVGYGSIQFGNDTQNPEEQAYTYRLVSRNPHPDYDYHLPRLNKLVTEISPTALSSVPLLGNGQPKANAYLDTDRFPYFVRLGSGTQQVRKADGTRTRTAPAYQYLTGGTPLKVLGFQNHGLLVGGSLTDQPLNTYAIAGDSGSPLFAFDKHENRWVLAGVLSTYAGFDNFFNKYIVTQPEFIRSTIRQYETRLDVGLTTNELIWRDNGNGNSTLQGLNERITLPIANPSLAPQNDSRHMPSEDAGKTLILSSRFDNKTLMLADNINQGAGALQFDSNFTVVGKNHTWQGAGVIVADGKRVFWQVSNPKGDRLSKLGAGTLIANGQGINQGDISIGEGTVVLAQKAASDGSKQAFNQVGITSGRGTAVLADSQQIKPENLYFGFRGGRLDLNGNNLAFTHIRHADGGAQIVNHNPDQAATLTLTGNPVLSPEHVEWVQWGNRPQGNAAVYEYINPHRNRRTDYFILKPGGNPREFFPLNMKNSTSWQFIGNNRQQAAEQVAQAENARPDLITFGGYLGENAQTGKAAPSYSKTNEAAIEKTRHIANAAVYGRPEYRYNGALNLHYRPKRTDSTLLLNGGMNLNGEVLIEGGNMIVSGRPVPHAYDHQAKREPVLENEWTDGSFKAARFTLRNHARLTAGRNTAHLDGDITAYDLSGIDLGFTQGKTPECYRSYHSGSTHCTPNAVLKAENYRALPATQVRGDITLNDRSELRLGKAHLYGSIRAGKDTAVRMEADSNWTLSQSSHTGALTLDGAQITLNPDFANNTHNNRFNTLTVNGTLDGFGTFRFLTGIVRKQNAPPLKLEGDSRGAFQIHVKNTGQEPQTTESLALVSLNPKHSHQARFTLQNGYADLGAYRYILRKNNNGYSLYNPLKEAELQIEATRAEHERNQQAYNQLQATDISRQVQHDSDATRQALQAWQNSQTELARIDSQVQYLSAQLKQTDPLTGILTRAQNLCAAQGYSADICRQVAKAADTNDLTLFETELDTYIERVEMAESELDKARQGGDAQAVETARHAYLNALNRLSRQIHSLKTGVAGIRMPNLAELISRSANTAVSEQAAYNTGRQQAGRRIDRHLTDPQQQNIWLETGTQQTDYHSGTHRPYQQTTNYAHIGIQTGITDRLSVGTILTDERTNNRFDEGVSARNRSNGAHLFVKGENGALFAAADLGYSNSRTRFTDYDGAAVRRHAWDAGINTGIKIDTGINLRPYAGIRINRSNGNRYVLDGAEINSPAQIQTTWHAGIRLDKTVELGQAKLTPAFSSDYYHTRQNSGSALSVNDRTLLQQAAHGTLHTLQIDAGYKGWNAKLHAAYGKDSNTARHKQAGIKIGYNW

SEQ ID NO: 2603 - DNA, 465 bp, Neisseria gonorrhoeae
aacaaccgcaacacccgttacgccgcattgggcaaacgcgtgatggaaggcgttgagaccgaaatcagcggtgcgattacaccgaaatggcaaatccatgcaggttacagctatctgcacagccaaatcaaaaccgccgccaatccacgcgacgacggcatcttcctgctggtgcccaaacacagcgcaaacctgtggacgacttaccaagttacgcccgggctgaccgtcggcggcggcgtgaacgcgatgagcggcattacttcatctgcagggatgcatgcaggcggttatgccacgttcgatgcgatggcggcataccgcttcacgcccaagctgaagctgcaaatcaatgccgacaacatcttcaaccgccattactacgcccgcgtcggcggcacgaacacctttaacattcccggttcggagcgcagcctgacggcaaacctgcgttacagtttttaa

SEQ ID NO: 2604 - protein, 154 aa, Neisseria gonorrhoeae
NNRNTRYAALGKRVMEGVETEISGAITPKWQIHAGYSYLHSQIKTAANPRDDGIFLLVPKHSANLWTTYQVTPGLTVGGGVNAMSGITSSAGMHAGGYATFDAMAAYRFTPKLKLQINADNIFNRHYYARVGGTNTFNIPGSERSLTANLRYSF

SEQ ID NO: 2605 - DNA, 2127 bp, Neisseria meningitidis
atgggacagtttatgtcagttttccgcatcaatatgaccgccgccacggttttggcagcactctcgtcttcggtttttgccgcacaaacggaaggtttggaaaccgtccatattaagggtcagcgttcttacaacgcgattgccaccgagaaaaacggcgattacagctcgtttgccgccaccgtcggtacaaaaatccccgcttctttgcgcgaaattccgcaatccgtcagcatcattaccaaccagcaggtcaaagaccgcaatgttgatacgtttgaccagttggcacgcaaaacgcccggcctgcgcgtgttgagcaacgacgacggacgctcttcggtttacgcgcgcggttacgaatacagcgaatacaacatcgacggcctgcccgcgcagatgcagagtatcaacggcacgctgcccaacctgttcgccttcgaccgcgtggaagtgatgcgcgggccgagcggactgttcgacagcagcggcgagatgggcggcatcgtgaatctggtgcgcaaacgcccgaccaaagcgttccaaggtcatgcggcggcagggttcggtacgcacaaacaatataaagccgaggcggacgtatcgggcagcctcaattcagacggcagcgtgcgcggccgcgtgatggcgcagaccgtcggcgcgtctccgcgtcccgccgagaaaaacaaccggcgcgaaaccttctacgcggcggcggattgggacatcaaccccgatacggttttgggcgcgggctatctttaccagcaacgccgcctcgcgccgtacaacggcctgcctgccgatgccaataacaaattaccgtccctgccgcaacacgtatttgtcggcgcggattggaacaaatttaaaatgcacagccacgacgtgttcgccgatttgaaacattacttcggcaacggcggctacggcaaagtcggtatgcgctattccgatcggaaagccgattccaattatacgtttgcgggcagcaaactcaacaataccggacaagccgacgtagcgggtttgggtacggacattaaacaaaaagcctttgcggttgacgcaagttacagccgtccgtttgccttgggcaacaccgccaacgaatttgtgattggtgcagactacaaccgcttgcgcagtactaatgaacaagggcgttcgactttgtcaaaaagcgtcgctttagatggtttccgcgctttgccttataacggcatacttcagaacgcccgcgccggaaacaaaggtttcaatcactccgttaccgaagaaaacctcgacgaaaccggtttgtatgccaagacggtgttccgtcctctggaaggtttgtcgttgattgcaggcggacgtgtaggacatcacaaaatcgagtcgggcgacggcaaaaccctgcataaagcttcgaaaaccaaatttacaagctacgccggcgcggtttacgatatagacggcagcaacagcctgtacgcttccgcctcccaactctacacaccgcaaaccagcatcggcaccgacggcaagctgctcaaaccgcgcgaaggcaaccagtttgaaatcggctacaaaggcagctacatggacgaccgcctcaatacccgggtttcgttctaccgcatgaaggataaaaacgccgccgcaccgctggactcaaacaacaaaaaaacccgttacgccgcattgggcaaacgcgtgatggaaggtgttgagaccgaaatcagcggcgcgatgacaccgaaatggcaaatccatgcaggttacagctacctgcacagccaaatcaaaaccgcctccaattcgcgcgacgaaggcatcttcctgctgatgcccaaacacagcgcaaacctgtggacgacttaccaagttacgtccgggctgaccatcggcggcggcgtgaacgcgatgagcggcattacttcatctgcagggatacatgcaggcggttatgccacgttcgatgcgatggcggcataccgcttcacgcccaaactgaagctgcaaatcaacgccgacaacatcttcaaccgccattactacgcccgcgtcggcagcgagagcacctttaacattcccggttcggagcgcagcctgacggcaaacctgcgttacagtttttaa

SEQ ID NO: 2606 - protein, 708 aa, Neisseria meningitidis
MGQFMSVFRINMTAATVLAALSSSVFAAQTEGLETVHIKGQRSYNAIATEKNGDYSSFAATVGTKIPASLREIPQSVSIITNQQVKDRNVDTFDQLARKTPGLRVLSNDDGRSSVYARGYEYSEYNIDGLPAQMQSINGTLPNLFAFDRVEVMRGPSGLFDSSGEMGGIVNLVRKRPTKAFQGHAAAGFGTHKQYKAEADVSGSLNSDGSVRGRVMAQTVGASPRPAEKNNRRETFYAAADWDINPDTVLGAGYLYQQRRLAPYNGLPADANNKLPSLPQHVFVGADWNKFKMHSHDVFADLKHYFGNGGYGKVGMRYSDRKADSNYTFAGSKLNNTGQADVAGLGTDIKQKAFAVDASYSRPFALGNTANEFVIGADYNRLRSTNEQGRSTLSKSVALDGFRALPYNGILQNARAGNKGFNHSVTEENLDETGLYAKTVFRPLEGLSLIAGGRVGHHKIESGDGKTLHKASKTKFTSYAGAVYDIDGSNSLYASASQLYTPQTSIGTDGKLLKPREGNQFEIGYKGSYMDDRLNTRVSFYRMKDKNAAAPLDSNNKKTRYAALGKRVMEGVETEISGAMTPKWQIHAGYSYLHSQIKTASNSRDEGIFLLMPKHSANLWTTYQVTSGLTIGGGVNAMSGITSSAGIHAGGYATFDAMAAYRFTPKLKLQINADNIFNRHYYARVGSESTFNIPGSERSLTANLRYSF

SEQ ID NO: 2607 - DNA, 2112 bp, Neisseria meningitidis
atgaaaatatcatttcatttagctttattacccacgctgattattgcttccttccctgttgctgccgccgatacgcaggacaatggtgaacattacaccgccactctgcccaccgtttccgtggtcggacagtccgacaccagcgtactcaaaggctacatcaactacgacgaagccgccgttacccgcaacggacagctcatcaaagaaacgccgcaaaccatcgatacgctcaatatccagaaaaacaaaaattacggtacgaacgatttgagttccatcctcgaaggcaatgccggcatcgacgctgcctacgatatgcgcggtgaaagcattttcctgcgcggttttcaagccgacgcatccgatatttaccgcgacggcgtgcgcgaaagcggacaagtgcgccgcagtactgccaacatcgagcgcgtggaaatcctgaaaggcccgtcttccgtgctttacggccgcaccaacggcggcggcgtcatcaacatggtcagcaaatacgccaacttcaaacaaagccgcaacatcggagcggtttacggctcatgggcaaaccgcagcctgaatatggacattaacgaagtgctgaacaaaaacgtcgccatccgtctcaccggcgaagtcgggcgcgccaattcgttccgcagcggcatagacagcaaaaatgtcatggtttcgcccagcattaccgtcaaactcgacaacggcttgaagtggacggggcaatacacctacgacaatgtggagcgcacgcccgaccgcagtccgaccaagtccgtgtacgaccgcttcggactgccttaccgcatggggttcgcccaccggaacgattttgtcaaagacaagctgcaagtttggcgttccgaccttgaatacgccttcaacgacaaatggcgtgcccaatggcagctcgcccaccgcacggcggcgcaggattttgatcatttctatgcaggcagcgaaaatggcaacttaatcaaacgtaactacgcctggcagcagaccgacaacaaaaccctgtcgtccaacttaacgctcaacggcgactacaccatcggccgttttgaaaaccacctgaccgtaggcatggattacagccgcgaacaccgcaacccgacattgggtttcagcagcgccttttccgcctccatcaacccctacgaccgcgcaagctggccggcttcgggcagattgcagcctattctgacccaaaaccgccacaaagccgactcctacggcatctttgtgcaaaacatcttctccgccacgcccgatttgaaattcgtcctcggcggccgttacgacaaatacacctttaattccgaaaacaaactcaccggcagcagccgccaatacagcggacactcgttcagccccaacatcggcgcagtgtggaacatcaatcccgtccacacactttacgcctcgtataacaaaggcttcgcgccttatggcggacgcggcggctatttgagcatcgatacgttgtcttccgccgtgttcaacgccgaccccgagtacacccgccaatacgaaaccggcgtgaaaagcagttggctggacgaccgcctcagcactacgttgtctgcctaccaaatcgaacgcttcaatatccgctaccgccccgatccaaaaaacaacccttatatttatgcggttagcggcaaacaccgttcgcgcggcgtggaattgtccgccatcgggcaaatcatccccaaaaaactctatctgcgcggttcgttgggcgtgatgcaggcgaaagtcgttgaagacaaagaaaatcccgaccgagtgggcatccatttgaataataccagcaacgttaccggcaacctgtttttccgttataccccgaccgaaaacctctacggcgaaatcggcgtaaccggtacaggcaaacgctacggttacaactcaagaaataaagaagtgactacgcttccaggctttgcccgagttgatgccatgcttggctggaaccataaaaatgttaacgttacctttgccgcagccaatctgctcaatcaaaaatattggcgttcggactctatgccgggtaatccgcgcggctatactgcccgggtaaattaccgtttctga

SEQ ID NO: 2608 - protein, 703 aa, Neisseria meningitidis
MKISFHLALLPTLIIASFPVAAADTQDNGEHYTATLPTVSVVGQSDTSVLKGYINYDEAAVTRNGQLIKETPQTIDTLNIQKNKNYGTNDLSSILEGNAGIDAAYDMRGESIFLRGFQADASDIYRDGVRESGQVRRSTANIERVEILKGPSSVLYGRTNGGGVINMVSKYANFKQSRNIGAVYGSWANRSLNMDINEVLNKNVAIRLTGEVGRANSFRSGIDSKNVMVSPSITVKLDNGLKWTGQYTYDNVERTPDRSPTKSVYDRFGLPYRMGFAHRNDFVKDKLQVWRSDLEYAFNDKWRAQWQLAHRTAAQDFDHFYAGSENGNLIKRNYAWQQTDNKTLSSNLTLNGDYTIGRFENHLTVGMDYSREHRNPTLGFSSAFSASINPYDRASWPASGRLQPILTQNRHKADSYGIFVQNIFSATPDLKFVLGGRYDKYTFNSENKLTGSSRQYSGHSFSPNIGAVWNINPVHTLYASYNKGFAPYGGRGGYLSIDTLSSAVFNADPEYTRQYETGVKSSWLDDRLSTTLSAYQIERFNIRYRPDPKNNPYIYAVSGKHRSRGVELSAIGQIIPKKLYLRGSLGVMQAKVVEDKENPDRVGIHLNNTSNVTGNLFFRYTPTENLYGEIGVTGTGKRYGYNSRNKEVTTLPGFARVDAMLGWNHKNVNVTFAAANLLNQKYWRSDSMPGNPRGYTARVNYRF

SEQ ID NO: 2609 - DNA, 2112 bp, Neisseria meningitidis
atgaaaatatcatttcatttagctttattacccacgctgattattgcttccttccctgttgctgccgccgatacgcaggacaatggtgaacattacaccgccactctgcccaccgtttccgtggtcggacagtccgacaccagcgtactcaaaggctacatcaactacgacgaagccgccgttacccgcaacggacagctcatcaaagaaacgccgcaaaccatcgatacgctcaatatccagaaaaacaaaaattacggcacgaacgatttgagttccatcctcgaaggcaatgccggcatcgacgccgcctacgatatgcgcggcgaaagcattttcctgcgcggctttcaagccgacgcatctgatatttaccgcgacggcgtacgcgaaagcgggcaggtgcgccgtagcaccgccaacatcgagcgcgtggaaatcctgaaaggtccgtcctccgtgctttatgggcgtaccaacggcggcggtgtcatcaacatggtcagcaaatacgccaacttcaaacaaagccgtaatatcggtacggtttatggttcgtgggcaaaccgcagcctgaatatggacatcaacgaagtgctgaacaaaaacgtcgccatccgtctcaccggcgaagtcgggcgcgccaattcgttccgcagcggcatagacagcaaaaatgtcatggtttcgcccagcattaccgtcaaactcgacaacggcttgaagtggacggggcaatacacctacgacaatgtggagcgcacgcccgaccgcagtccgaccaagtccgtgtacgaccgcttcggactgccttaccgcatggggttcgcccaccggaacgattttgtcaaagacaagctgcaagtttggcgttccgaccttgaatacgccttcaacgacaaatggcgtgcccaatggcagctcgcccaccgcacggcggcgcaggattttgatcatttctatgcaggcagcgaaaatggcaacttaatcaaacgtaactacgcctggcagcagaccgacaacaaaaccctgtcgtccaacttaacgctcaacggcgactacaccatcggccgttttgaaaaccacctgaccgtaggcatggattacagccgcgaacaccgcaacccgacattgggtttcagcagcgccttttccgcctccatcaacccctacgaccgcgcaagctggccggcttcgggcagattgcagcctattctgacccaaaaccgccacaaagccgactcctacggcatctttgtgcaaaacatcttctccgccacgcccgatttgaaattcgtcctcggcggccgttacgacaaatacacctttaattccgaaaacaaactcaccggcagcagccgccaatacagcggacactcgttcagccccaacatcggcgcagtgtggaacatcaatcccgtccacacactttacgcctcgtataacaaaggcttcgcgccttatggcggacgcggcggctatttgagcatcgatacgttgtcttccgccgtgttcaacgccgaccccgagtacacccgccaatacgaaaccggcgtgaaaagcagttggctggacgaccgcctcagcactacgttgtctgcctaccaaatcgaacgcttcaatatccgctaccgccccgatccaaaaaacaacccttatatttatgcggttagcggcaaacaccgttcgcgcggcgtggaattgtccgccatcgggcaaatcatccccaaaaaactctatctgcgcggttcgttgggcgtgatgcaggcgaaagtcgttgaagacaaagaaaatcccgaccgagtgggcatccatttgaataacaccagcaacgttaccggcaacctgtttttccgttataccccgaccgaaaacctctacggcgaaatcggcgtaaccggtacaggcaaacgctacggttacgactcaagaaataaagaagtgactacgcttccaggctttgcccgagttgatgccatgcttggctggaaccataaaaatgttaacgttacctttgccgcagccaatctgttcaatcaaaaatattggcgttcggactctatgccgggtaatccgcgcggctatactgcccgggtaaattaccgtttctga

SEQ ID NO: 2610 - protein, 703 aa, Neisseria meningitidis
MKISFHLALLPTLIIASFPVAAADTQDNGEHYTATLPTVSVVGQSDTSVLKGYINYDEAAVTRNGQLIKETPQTIDTLNIQKNKNYGTNDLSSILEGNAGIDAAYDMRGESIFLRGFQADASDIYRDGVRESGQVRRSTANIERVEILKGPSSVLYGRTNGGGVINMVSKYANFKQSRNIGTVYGSWANRSLNMDINEVLNKNVAIRLTGEVGRANSFRSGIDSKNVMVSPSITVKLDNGLKWTGQYTYDNVERTPDRSPTKSVYDRFGLPYRMGFAHRNDFVKDKLQVWRSDLEYAFNDKWRAQWQLAHRTAAQDFDHFYAGSENGNLIKRNYAWQQTDNKTLSSNLTLNGDYTIGRFENHLTVGMDYSREHRNPTLGFSSAFSASINPYDRASWPASGRLQPILTQNRHKADSYGIFVQNIFSATPDLKFVLGGRYDKYTFNSENKLTGSSRQYSGHSFSPNIGAVWNINPVHTLYASYNKGFAPYGGRGGYLSIDTLSSAVFNADPEYTRQYETGVKSSWLDDRLSTTLSAYQIERFNIRYRPDPKNNPYIYAVSGKHRSRGVELSAIGQIIPKKLYLRGSLGVMQAKVVEDKENPDRVGIHLNNTSNVTGNLFFRYTPTENLYGEIGVTGTGKRYGYDSRNKEVTTLPGFARVDAMLGWNHKNVNVTFAAANLFNQKYWRSDSMPGNPRGYTARVNYRF

SEQ ID NO: 2611 - DNA, 444 bp, Neisseria meningitidis
atgaagtggttattaaatatgataatgagacctattaaatttagtatggtaaatacgttattatttattgttatatgtagttcattttttgatctgctcgttcaattatgtacaattttatttcatagccaaaaaatatactttattacattatttttattatttatttttaattttgttacaaaatctatctatatggcaattatttatcctattttatatttttttacgataaaaaaatattatccttactctaggaaagtgataattctattatcattagcattatctatatattttagttttatggacttttactttttttccatatattcagataaccttagctatgaaacggagcctttacatttatacatccctattattattaattttttctcacttttagtttctaattttattttatcttttatcaacaagtaa

SEQ ID NO: 2612 - protein, 147 aa, Neisseria meningitidis
MKWLLNMIMRPIKFSMVNTLLFIVICSSFFDLLVQLCTILFHSQKIYFITLFLLFIFNFVTKSIYMAIIYPILYFFTIKKYYPYSRKVIILLSLALSIYFSFMDFYFFSIYSDNLSYETEPLHLYIPIIINFFSLLVSNFILSFINK

SEQ ID NO: 2613 - DNA, 444 bp, Neisseria meningitidis; identical to SEQ ID NO: 2611

SEQ ID NO: 2614 - protein, 147 aa, Neisseria meningitidis; identical to SEQ ID NO: 2612

SEQ ID NO: 2615 - DNA, 1404 bp, Neisseria meningitidis
atgacattgctcaatctaatgataatgcaagattacggtatttccgtttgcctgacactgacgccctatttgcaacatgaactattttcggctatgaaatcctatttttccaaatatatcctacccgtttcactttttaccttgccactatccctttccccatccgtttcggcttttacgctgcctgaagcatggcgggcggcgcagcaacattcggctgattttcaagcgtcccattaccagcgtgatgcagtgcgcgcacggcaacaacaagccaaggccgcattccttccccatgtatccgccaatgccagctaccagcgccagccgccatcgatttcttccacccgcgaaacacagggatggagcgtgcaggtgggacaaaccttatttgacgctgccaaatttgcacaataccgccaaagcaggttcgatacgcaggctgcagaacagcgtttcgatgcggcacgcgaagaattgctgttgaaagttgccgaaagttatttcaacgttttactcagccgagacaccgttgccgcccatgcggcggaaaaagaggcttatgcccagcaggtaaggcaggcgcaggctttattcaataaaggtgctgccaccgcgctggatattcacgaagccaaagccggttacgacaatgccctggcccaagaaatcgccgtattggctgagaaacaaacctatgaaaaccagttgaacgactacaccgacctggatagcaaacaaatcgaggccatagataccgccaacctgttggcacgctatctgcccaagctggaacgttacagtctggatgaatggcagcgcattgccttatccaacaatcatgaataccggatgcagcagcttgccctgcaaagcagcggacaggcgcttcgggcagcacagaacagccgctatcccaccgtttctgcccatgtcggctatcagaataacctctacacttcatctgcgcagaataatgactaccactatcggggcaaagggatgagcgtcggcgtacagttgaatttgccgctttataccggcggagaattgtcgggcaaaatccatgaagccgaagcgcaatacggggccgccgaagcacagctgaccgcaaccgagcggcacatcaaactcgccgtacgccaggcttataccgaaagcggtgcggcgcgttaccaaatcatggcgcaagaacgggttttggaaagcagccgtttgaaactgaaatcgaccgaaaccggccaacaatacggcatccgcaaccggctggaagtaatacgggcgcggcaggaagtcgcccaagcagaacagaaactggctcaagcacggtataaattcatgctggcttatttgcgcttggtgaaagagagcgggttagggttggaaacggtatttgcggaataa

SEQ ID NO: 2616 - protein, 467 aa, Neisseria meningitidis
MTLLNLMIMQDYGISVCLTLTPYLQHELFSAMKSYFSKYILPVSLFTLPLSLSPSVSAFTLPEAWRAAQQHSADFQASHYQRDAVRARQQQAKAAFLPHVSANASYQRQPPSISSTRETQGWSVQVGQTLFDAAKFAQYRQSRFDTQAAEQRFDAAREELLLKVAESYFNVLLSRDTVAAHAAEKEAYAQQVRQAQALFNKGAATALDIHEAKAGYDNALAQEIAVLAEKQTYENQLNDYTDLDSKQIEAIDTANLLARYLPKLERYSLDEWQRIALSNNHEYRMQQLALQSSGQALRAAQNSRYPTVSAHVGYQNNLYTSSAQNNDYHYRGKGMSVGVQLNLPLYTGGELSGKIHEAEAQYGAAEAQLTATERHIKLAVRQAYTESGAARYQIMAQERVLESSRLKLKSTETGQQYGIRNRLEVIRARQEVAQAEQKLAQARYKFMLAYLRLVKESGLGLETVFAE

SEQ ID NO: 2617 - DNA, 1404 bp, Neisseria meningitidis
atgacattgctcaatctaatgataatgcaagattacggtatttccgtttgcctgacactgacgccctatttgcaacatgaactattttcggctatgaaatcctatttttccaaatatatcctacccgtttcactttttaccttgccactatccctttccccatccgtttcggcttttacgctgcctgaagcatggcgggcggcgcagcaacattcggctgattttcaagcgtcccattaccagcgtgatgcagtgcgcgcacggcaacaacaagccaaggccgcattccttccccatgtatccgccaatgccagctaccagcgccagccgccatcgatttcttccacccgcgaaacacagggatggagcgtgcaggtgggacaaaccttatttgacgctgccaaatttgcacaataccgccaaagcaggttcgatacgcaggctgcagaacagcgtttcgatgcggcacgcgaagaattgctgttgaaagttgccgaaagttatttcaacgttttactcagccgagacaccgttgccgcccatgcggcggaaaaagaggcttatgcccagcaggtaaggcaggcgcaggctttattcaataaaggtgctgccaccgcgctggatattcacgaagccaaagccggttacgacaatgccctggcccaagaaatcgccgtattggctgagaaacaaacctatgaaaaccagttgaacgactacaccggcctggacagcaaacaaatcgaggccatagataccgccaacctgttggcacgctatctgcccaagctggaacgttacagtctggatgaatggcagcgcattgccttatccaacaatcatgaataccggatgcagcagcttgccctgcaaagcagcggacaggcgcttcgggcagcacagaacagccgctatcccaccgtttctgcccatgtcggctatcagaataacctctacacttcatctgcgcagaataatgactaccactatcggggcaaagggatgagcgtcggcgtacagttgaatttgccgctttataccggcggagaattgtcgggcaaaatccatgaagccgaagcgcaatacggggctgccgaagcacagctgaccgcaaccgagcggcacatcaaactcgccgtacgccaggcttataccgaaagcggtgcggcgcgttaccaaatcatggcgcaagaacgggttttggaaagcagccgtttgaaactgaaatcgaccgaaaccggccaacaatacggcatccgcaaccggctggaagtaatacgggcgcggcaggaagtcgcccaagcagaacagaaactggctcaagcacggtataaattcatgctggcttatttgcgcttggtgaaagagagcgggttagggttggaaacggtatttgcggaataa

SEQ ID NO: 2618 - protein, 467 aa, Neisseria meningitidis
MTLLNLMIMQDYGISVCLTLTPYLQHELFSAMKSYFSKYILPVSLFTLPLSLSPSVSAFTLPEAWRAAQQHSADFQASHYQRDAVRARQQQAKAAFLPHVSANASYQRQPPSISSTRETQGWSVQVGQTLFDAAKFAQYRQSRFDTQAAEQRFDAAREELLLKVAESYFNVLLSRDTVAAHAAEKEAYAQQVRQAQALFNKGAATALDIHEAKAGYDNALAQEIAVLAEKQTYENQLNDYTGLDSKQIEAIDTANLLARYLPKLERYSLDEWQRIALSNNHEYRMQQLALQSSGQALRAAQNSRYPTVSAHVGYQNNLYTSSAQNNDYHYRGKGMSVGVQLNLPLYTGGELSGKIHEAEAQYGAAEAQLTATERHIKLAVRQAYTESGAARYQIMAQERVLESSRLKLKSTETGQQYGIRNRLEVIRARQEVAQAEQKLAQARYKFMLAYLRLVKESGLGLETVFAE

SEQ ID NO: 2619 - DNA, 1428 bp, Neisseria meningitidis
atgtttttctccgccctgaaatcctttctttctcgatacattactgtatggcgcaatgtttgggcggtgcgcgaccagttgaaaccgcccaaacgcacggcggaagaacaggcgtttttgcccgcgcatttggaactgaccgatacgccggtctctgccgctccgaaatgggcggcgcgttttattatggcgtttgcgcttttggctttgttgtggtcctggttcggcaaaatcgatattgtggcggcggcttcgggcaaaacggtgtcgggcgggcgcagcaaaaccatccagccgctggaaacggcggtggttaaggcggtacatgtgcgcgacgggcagcatgtgaaacagggagaaacgctggcggaactggaggctgtgggaacagacagcgatgtggtgcagtcggagcaggctttgcaggctgcccaattgtccaaactgcgttatgaagcggtattggcggcattggaaagccgtaccgtgccgcatatcgatatggcgcaagcacggtctttaggtctctccgatgccgatgtgcaatcggcgcaggtgttggcgcagcaccagtatcaggcatgggcggcgcaggatgcgcaattgcagtcggctttgcgcggccatcaggcggaattgcagtcggccaaggcgcaggagcagaagctggtttcggtgggggcgatcgagcagcagaaaacagcagactaccgccgtttgcgggccgacaattttatttcggaacatgcgtttttggagcagcagagcaaatcggtcagcaattggaacgatttggaaagtacgcgcggtcagatgaggcagattcaggcggccattgcacaggcggagcagaatcgggtgctgaatacgcagaacctgaaacgcgatacgctggatgcgctgcgccaggcaaacgaacagattgaccaataccgcggccaaacggataaggcaaagcagcggcagcagctgatgacaatacagtcgcctgcggacggcacggtgcaggaattggctacctatacggtgggcggtgtggtgcaggctgcccaaaaaatgatggtgattgcgcccgatgacgacaaaatggacgtggaagttttggtattgaacaaagacatcggttttgtggaacagggacaggatgcggtggtgaagattgagagctttccctatacgcgctacggttatctgacgggcaaggtgaaaagtgtcagccatgatgcggtaagccacgaacagttgggcttggtttatacggcggtggtgtcgctggacaaacataccttgaatattgacggcaaagcagtgaatctgacggcgggcatgaatgtcacggcggagattaaaacgggtaaacggcgggtgctggattatctgttaagcccgctgcaaaccaaattggacgaaagctttagggagcgatag

SEQ ID NO: 2620 - protein, 475 aa, Neisseria meningitidis
MFFSALKSFLSRYITVWRNVWAVRDQLKPPKRTAEEQAFLPAHLELTDTPVSAAPKWAARFIMAFALLALLWSWFGKIDIVAAASGKTVSGGRSKTIQPLETAVVKAVHVRDGQHVKQGETLAELEAVGTDSDVVQSEQALQAAQLSKLRYEAVLAALESRTVPHIDMAQARSLGLSDADVQSAQVLAQHQYQAWAAQDAQLQSALRGHQAELQSAKAQEQKLVSVGAIEQQKTADYRRLRADNFISEHAFLEQQSKSVSNWNDLESTRGQMRQIQAAIAQAEQNRVLNTQNLKRDTLDALRQANEQIDQYRGQTDKAKQRQQLMTIQSPADGTVQELATYTVGGVVQAAQKMMVIAPDDDKMDVEVLVLNKDIGFVEQGQDAVVKIESFPYTRYGYLTGKVKSVSHDAVSHEQLGLVYTAVVSLDKHTLNIDGKAVNLTAGMNVTAEIKTGKRRVLDYLLSPLQTKLDESFRER

SEQ ID NO: 2621 - DNA, 1305 bp, Neisseria meningitidis
atgtttttctccgccctgaaatcctttctttcccgctacattaccgtatggcgcaatgtttgggcggtgcgcgaccagttggaaccgcccaaacgcacggcggaagaacaggcgtttttgcccgcgcatttggaactgaccgatacgccggtctctgccgctccgaaatgggcggcgcgttttattatggcgtttgcgcttttggctttgttgtggtcctggttcggcaaaatcgatattgtggcggcggcttcgggcaaaacggtgtcgggcgggcgcagcaaaaccatccagccgctggaaacggtggtggttaaggcggtacatgtgcgcgacgggcagcatgtgaaacagggagaaacgctggcggaactggaggctgtgggaacagacagcgatgtggtgcagtcggagcaggctttgcaggctgcccaattgtccaaactgcgttatgaagcggtattggcggcattggaaagccgtaccgtgccgcatatcgatatggcgcaagcacggtctttaggtctctccgatgccgatgtgcaatcggcgcaggtgttggcgcagcaccagtatcaggcatgggcggcgcaggatgcgcaattgcagtcggctttgcgcggccatcaggcggaattgcagtcggccaaggcgcaggagcagaagctggtttcggtgggggcgatcgagcagcagaaaacagcagactaccgccgtttgcgggccgacaattttatttcggaacatgcgtttttggagcagcagagcaaatcggtcagcaattggaacgatttggaaagtacgcgcggtcagatgaggcagattcaggcggccattgcacaggcggagcagaatcgggtgctgaatacgcagaacctgaaacgcgatacgctggatgcgctgcgccaggcaaacgaacagattgaccaataccgcggccaaacggataaggcaaagcagcggcagcagctgatgacaatacagtcgcctgcggacggcacggtgcaggaattggccacctatacggtgggcggtgtggtgcaggctgcccaaaaaatgatggtggttgcgcccgatgacgacaaaatggacgtggaagttttggtattgaacaaagacatcggttttgtggaacagggacaggatgcggtggtgaagattgagagttttccctatacgcgctacggttatctgacgggcaaggtgaaaagtgtcagccatgatgcggtaagccacgaacagttgggcttggtttatacggcggtggtgtcgctggacaaacataccttgaatattgacggcaaa

SEQ ID NO: 2622 - protein, 435 aa, Neisseria meningitidis
MFFSALKSFLSRYITVWRNVWAVRDQLEPPKRTAEEQAFLPAHLELTDTPVSAAPKWAARFIMAFALLALLWSWFGKIDIVAAASGKTVSGGRSKTIQPLETVVVKAVHVRDGQHVKQGETLAELEAVGTDSDVVQSEQALQAAQLSKLRYEAVLAALESRTVPHIDMAQARSLGLSDADVQSAQVLAQHQYQAWAAQDAQLQSALRGHQAELQSAKAQEQKLVSVGAIEQQKTADYRRLRADNFISEHAFLEQQSKSVSNWNDLESTRGQMRQIQAAIAQAEQNRVLNTQNLKRDTLDALRQANEQIDQYRGQTDKAKQRQQLMTIQSPADGTVQELATYTVGGVVQAAQKMMVVAPDDDKMDVEVLVLNKDIGFVEQGQDAVVKIESFPYTRYGYLTGKVKSVSHDAVSHEQLGLVYTAVVSLDKHTLNIDGK

SEQ ID NO: 2623 - DNA, 930 bp, Neisseria meningitidis
atgttaagatgccgtccgaaatccgttttggattcagacggcatttttttgaaatttaattttttaaggagtaaacctaaatatgaaatttccttccttccttcctttaaacggatactctgcctgtcggcagtaatctcggtattgggggcttgtgcggtcgttgctgatgtttacggtcatgattccgccacaatgaacgctgcggctgccaaagattatatgaaaacggttgagttaaacaagtctgccggcaatgtcgataccacatccagaacagcccgcagggtgcaggcagtatttcgacgtatgctgccttatgccgatgcggcaaataataccagccataagtttgactggaaaatgacggttttcaaaaacgatgagctgaacgcgtgggcaatgcccggtggaaaaatggcgttttatacggggatagtcgacaaactcaagctgaccgatgacgaaattgccgccattatggggcatgaaatgacgcacgccctgcatgaacacggtaaaaataaggtcgggcagcaaatcttgaccaatacggcggcgcagataggcacgcagattatattagacaaaaaaccggatactaatccggaattggtcggattgggtatggatattttggggacgtacggtcttaccttgccttatagccgcagcttggaagaagaagccgatgaggggggaatgatgttgatggcgcaggcaggctatcatccggcggccgctgtcagggtttgggaaaaaatgaatcaggaaaacgaccaaaacggctttatttatgctattacctctactcatccgacaaacaatgcccgtatagaaaatctaaaacggttgttgccgaccgttatgccggtttatgagcaaagtgtcagaaataaggggcgcgttaataaaaaacgtcggcgttaa

SEQ ID NO: 2624 - protein, 309 aa, Neisseria meningitidis
MLRCRPKSVLDSDGIFLKFNFLRSKPKYEISFLPSFKRILCLSAVISVLGACAVVADVYGHDSATMNAAAAKDYMKTVELNKSAGNVDTTSRTARRVQAVFRRMLPYADAANNTSHKFDWKMTVFKNDELNAWAMPGGKMAFYTGIVDKLKLTDDEIAAIMGHEMTHALHEHGKNKVGQQILTNTAAQIGTQIILDKKPDTNPELVGLGMDILGTYGLTLPYSRSLEEEADEGGMMLMAQAGYHPAAAVRVWEKMNQENDQNGFIYAITSTHPTNNARIENLKRLLPTVMPVYEQSVRNKGRVNKKRRR

SEQ ID NO: 2625 - DNA, 930 bp, Neisseria meningitidis
atgttaagatgccgtccgaaatccgttttggattcagacggcatttttttgaaatttaattttttaaggagtaaacctaaatatgaaatttccttccttccttcctttaaacggatactctgcctgtcggcagtaatctcggtattgggggcttgtacggtcgttgctgatgtttacggtcaggattccgccacaatgaatgctgcggctgccgaagattatatgaaaacggttgagttgaacaagtctgccggcaatgtcgatactacatccaaaacagcccgtagggtgcaggcagtatttcgacgtatgttgccttatgccgatgcggcaaataataccggccataagtttgactggaaaatgacggttttcaaaaacgatgagctgaacgcgtgggcaatgcccggcgggaaaatggcgttttatacggggatagtcgataaacttaagctgaccgatggcgaaattgccgccattatggggcatgaaatgacgcatgccctgcatgaacacggtaaaaataaggtcgggcagaaaatcttgactaatatggcggcgcagataggcacgcagattatattagacaaaaaaccggacactaatccggaattggtcggattgggtatggatattttggggatgtacggcattaccttgccttatagccgcagcttggaagaagaagccgatgaggggggaatgatgttgatggcgcaggcaggctatcatccggcagccgctgtcagggtttgggaaaaaatgaatcaggaaaacgaccaaaacggctttatttatgctattacctctactcatccgacaaacaatgcccgtatagaaaatctaaaacggttgttgccgaccgttatgccggtttatgagcacagtgttagaaataaggggcgcgttaataaaaaccgtcggcgttaa

SEQ ID NO: 2626 - protein, 309 aa, Neisseria meningitidis
MLRCRPKSVLDSDGIFLKFNFLRSKPKYEISFLPSFKRILCLSAVISVLGACTVVADVYGQDSATMNAAAAEDYMKTVELNKSAGNVDTTSKTARRVQAVFRRMLPYADAANNTGHKFDWKMTVFKNDELNAWAMPGGKMAFYTGIVDKLKLTDGEIAAIMGHEMTHALHEHGKNKVGQKILTNMAAQIGTQIILDKKPDTNPELVGLGMDILGMYGITLPYSRSLEEEADEGGMMLMAQAGYHPAAAVRVWEKMNQENDQNGFIYAITSTHPTNNARIENLKRLLPTVMPVYEHSVRNKGRVNKNRRR

SEQ ID NO: 2627 - DNA, 645 bp, Neisseria gonorrhoeae
atgaagtttaaacatctgttgccgctgctgctgtcggcagtgttgtccgcgcaggcatatgccctgacggaaggggaagactatcttgtgttggataaacccattcctcaagaacagccgggaaaaattgaggttttggaatttttcggctatttttgcgtacattgccatcatttcgatcctttgttattgaaactgggcaaggcattgccgtctgatacttatctgcggacggagcacgtggtctggcggcctgaaatgctcggtctggcaagaatggctgctgcggtcaagctgtcgggtttgaaatatcaggcaaactctgctgtgtttaaagcagtttacgaacaaaaaatccgtttggaaaacagggctgttgccgggaaatgggctttatctcaaaaaggttttgacggcaaaaaactgatgcgcgcctatgattcccccgaagctgccgccgtcgcattaaaaatgcagaaactgacggaacaatacggtattgacagcacgccgaccgttattgtcggcggaaaataccgcgttatcttcaataatggctttgatggcggcgttcatacgattaaagaattggttgccaaagtcagggaagaacgcaagcgtcagacccctgctgtacagaaatag

SEQ ID NO: 2628 - protein, 214 aa, Neisseria gonorrhoeae
MKFKHLLPLLLSAVLSAQAYALTEGEDYLVLDKPIPQEQPGKIEVLEFFGYFCVHCHHFDPLLLKLGKALPSDTYLRTEHVVWRPEMLGLARMAAAVKLSGLKYQANSAVFKAVYEQKIRLENRAVAGKWALSQKGFDGKKLMRAYDSPEAAAVALKMQKLTEQYGIDSTPTVIVGGKYRVIFNNGFDGGVHTIKELVAKVREERKRQTPAVQK

SEQ ID NO: 2629 - DNA, 645 bp, Neisseria meningitidis
atgaagctcaaacatctgttgccgctgctgctgtcggcagtgttgtccgcgcaggcatatgccctgacggaaggggaagactatcttgtgttggataaacccattcctcaagaacagtcgggtaaaattgaggttttggaatttttcggctatttctgcgtacattgccatcatttcgatcctttgttattgaaactgggcaaggcattgccgtctgatgcctatttgaggacggagcacgtggtctggcagcctgaaatgctcggtttggctaggatggcggctgccgtcaatttgtcgggtttgaaatatcaggcaaaccctgctgtgtttaaagcagtttacgaacaaaaaatccgcttggaaaacaggtcggttgccggaaaatgggctttgtctcaaaaaggctttgacggcaaaaaactgatgcgcgcctatgattcccccgaagctgccgccgccgcattaaaaatgcagaaactgacggaacaataccgcatcgacagcacgccgaccgttattgtcggcggaaaataccgcgttatcttcaataacggctttgacggcggcgttcatacgattaaagaattggttgccaaagtcagggaagaacgcaagcgtcagacccctgctgtacagaaatag

SEQ ID NO: 2630 - protein, 214 aa, Neisseria meningitidis
MKLKHLLPLLLSAVLSAQAYALTEGEDYLVLDKPIPQEQSGKIEVLEFFGYFCVHCHHFDPLLLKLGKALPSDAYLRTEHVVWQPEMLGLARMAAAVNLSGLKYQANPAVFKAVYEQKIRLENRSVAGKWALSQKGFDGKKLMRAYDSPEAAAAALKMQKLTEQYRIDSTPTVIVGGKYRVIFNNGFDGGVHTIKELVAKVREERKRQTPAVQK

SEQ ID NO: 2631 - DNA, 645 bp, Neisseria meningitidis
atgaagctcaaacatctgttgccgctgctgctgtcggcagtgttgtccgcgcaggcatatgccctgacggaaggggaagactatcttgtgttggataaacccattcctcaaaaacagtcgggcaaaattgaggttttggaatttttcggctatttctgcgtacattgccatcatttcgatcctttgttattgaaattgggcaaggcattgccgtctgatgcctatttaaggacggagcacgtggtctggcagcctgaaatgctcggtctggcaagaatggctgctgcggtcaagctgtcaggtttgaaatatcaggcaaaccctgccgtgtttaaagcagtttacgaacaaaaaatccgcttggaaaacaggtcggttgccgaaaaatgggctttgtctcaaaaaggctttgacggcaaaaaactgatgcgcgcctacgactctcctgcggcagcggctgctgcatcaaaaatgcagcaattgacggaacagtaccgcatcgacagtacgccgaccgttgtcgtcggcggaaaataccgcgttatcttcaataatggctttgacggcggtgttcatacgattaaagaattggttgccaaagtcagggaagaacgcaagcgtcagacccctgctgtacagaaatag

SEQ ID NO: 2632 - protein, 214 aa, Neisseria meningitidis
MKLKHLLPLLLSAVLSAQAYALTEGEDYLVLDKPIPQKQSGKIEVLEFFGYFCVHCHHFDPLLLKLGKALPSDAYLRTEHVVWQPEMLGLARMAAAVKLSGLKYQANPAVFKAVYEQKIRLENRSVAEKWALSQKGFDGKKLMRAYDSPAAAAAASKMQQLTEQYRIDSTPTVVVGGKYRVIFNNGFDGGVHTIKELVAKVREERKRQTPAVQK

SEQ ID NO: 2633 - DNA, 360 bp, Neisseria gonorrhoeae
atgaatatcaaacaattgattaccgccgcactcattgcctcagccgcctttgccacgcaggcagccccgcaaaaacccgtatccgccgcccaaaccgcgcaacattcagccgtttggatcgatgtccgttccgaacaggaatttagcgaaggtcatttgcacaacgcggtcaacatccccgtcgaccaaatcgtccgccgcatatacgaagccgcgcccgacaaagacacgccggtcaacctctactgccgcagcggacggcgtgccgaagccgcccttcaagagctgaaaaaagcaggttatacaaatgttgccaatcacggcggttatgaagacctgctcaaaaaagggatgaaatga

SEQ ID NO: 2634 - protein, 119 aa, Neisseria gonorrhoeae
MNIKQLITAALIASAAFATQAAPQKPVSAAQTAQHSAVWIDVRSEQEFSEGHLHNAVNIPVDQIVRRIYEAAPDKDTPVNLYCRSGRRAEAALQELKKAGYTNVANHGGYEDLLKKGMK

SEQ ID NO: 2635 - DNA, 360 bp, Neisseria meningitidis
atgaatatcaaacacctgattaccgccgcactcattgcctcagccgcctttgccgcgcaggcagccccgcaaaaacccgtatccgccgcccaaaccgcgcaacatccggccgtttggatcgatgtccgttccgaacaggaatttagcgaagggcatttgcacaacgcggtcaacatccccgtcgaccaaatcgtccgccgcatacacgaagccgcgcccgacaaagacacgccggtcaacctctactgccgcagcggacggcgtgccgaagccgcccttcaagagctgaaaaaagcaggttatacaaatgttgccaatcacggcggttatgaagacctgctcaaaaaagggatgaaatga

SEQ ID NO: 2636 - protein, 119 aa, Neisseria meningitidis
MNIKHLITAALIASAAFAAQAAPQKPVSAAQTAQHPAVWIDVRSEQEFSEGHLHNAVNIPVDQIVRRIHEAAPDKDTPVNLYCRSGRRAEAALQELKKAGYTNVANHGGYEDLLKKGMK

SEQ ID NO: 2637 - DNA, 360 bp, Neisseria meningitidis
atgaatatcaaacacctgattaccgccgcactcattgcctcagccgcctttgccgcgcaggcagccccgcaaaaacccgtatccgccgcccaaaccgcgcaacattcagccgtttggatcgatgtccgcagcgaacaggaatttagcgaaggtcatttgcacaacgcggtcaacatccccgtcgaccaaatcgtccgccgcatacacgaagccgcgcccgacaaagacacgccggtcaacctctactgccgcagcggacggcgtgccgaagccgcccttcaagaactgaaaaaagcaggctatacgaatgttgccaatcacggcggttatgaagacctgctcaaaaaagggatgaaatga

SEQ ID NO: 2638 - protein, 119 aa, Neisseria meningitidis
MNIKHLITAALIASAAFAAQAAPQKPVSAAQTAQHSAVWIDVRSEQEFSEGHLHNAVNIPVDQIVRRIHEAAPDKDTPVNLYCRSGRRAEAALQELKKAGYTNVANHGGYEDLLKKGMK

SEQ ID NO: 2639 - DNA, 1476 bp, Neisseria gonorrhoeae
ttgataatggttattttttatttttatttttgtgggaagacatttatgcctgcacgaaacagatggatgctgctgcctttattggcaagcgcggcatacgccgaagaaacaccgtgcgaaccggatttgagaagccgtcccgagttcaggcttcatgaagcggaggtcaaaccgatcgacagggagaaggtaccggggcaggtgcgggaaaaaggaaaagttttgcaggttgacggcgaaaccctgctgaaaaatcccgaattgttgtcgcgtgccatgtattccgcagtggtctcaaacaatattgccggtatccgcgtgattttgccgatttacctacaacaggcgcggcaggataagatgttggcactttatgcacaagggattttggcgcaggcagagggcagggtgaaggaggcggtttcccattaccgggaattgattgccgcccaacccgacgcgcccgccgtccgtatgcgtttggcggcggcattgtttgaagacaggcagaacgaggcggcggcagaccagttcgaccgcctgaaaacagaagatctgccgccgcagcttatggagcaggtcgagctgtaccgcaaggcattgcgcgaacgcgatgcgtggaaggtaaacggcggtttcagcgttacccgcgaacacaatatcaaccaagccccgaaacagcagcagtacggcaattggactttcccgaaacaggtggacggcacggcagtcaattaccggttcggcgcggagaaaaaatggtcgctgaaaaacggctggtacacgacggcgggcggcgacgtgtccggcagggtttatccggggaataagaaattcaacgatatgacggcaggtgtttccggcggcatcggttttgccgaccggcgtaaagatgtcgggctggcagtgttccacgaacgccgcacctacggcaacgacgcttattcttacgccaacggcgcacgcctttatttcaaccgttggcaaaccccgagatggcaaacgctgtcttcggcggagtgggggcgtttgaagaatacgcgccgggcgcgttccgacaatacccatttgcaaatttccaattcgctggtgttttaccggaatgcgcgccaatattggacgggcggtttggatttttaccgcgagcgcaaccccgccgaccgtggcgacaatttcaaccgttacggcctgcgctttgcctgggggcaggaatggggcggcagcggcctgtcttcgctgttccgcctcggcgtggcgaaacggcattatgaaaaacccggcttcttcagcagttttaaaggggaaaggcgcagggataaagaatcggacacatccttgagcctttggcaccgggcattgcatttcaaaggcatcacgccgcgcctgacgctgtcgcaccgcgaaacgtggagcaacgatgtgtttaacgaatacgagaaaaacagggcgtttgtcgagtttaacaaaacgttctga

SEQ ID NO: 2640 - protein, 491 aa, Neisseria gonorrhoeae
LIMVIFYFYFCGKTFMPARNRWMLLPLLASAAYAEETPCEPDLRSRPEFRLHEAEVKPIDREKVPGQVREKGKVLQVDGETLLKNPELLSRAMYSAVVSNNIAGIRVILPIYLQQARQDKMLALYAQGILAQAEGRVKEAVSHYRELIAAQPDAPAVRMRLAAALFEDRQNEAAADQFDRLKTEDLPPQLMEQVELYRKALRERDAWKVNGGFSVTREHNINQAPKQQQYGNWTFPKQVDGTAVNYRFGAEKKWSLKNGWYTTAGGDVSGRVYPGNKKFNDMTAGVSGGIGFADRRKDVGLAVFHERRTYGNDAYSYANGARLYFNRWQTPRWQTLSSAEWGRLKNTRRARSDNTHLQISNSLVFYRNARQYWTGGLDFYRERNPADRGDNFNRYGLRFAWGQEWGGSGLSSLFRLGVAKRHYEKPGFFSSFKGERRRDKESDTSLSLWHRALHFKGITPRLTLSHRETWSNDVFNEYEKNRAFVEFNKTF

SEQ ID NO: 2641 - DNA, 1473 bp, Neisseria meningitidis
ttgataatggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccgatcgacagggagaaggtgccggggcaggtgcgggaaaaaggaaaagttttgcagattgacggcgaaaccctgctgaaaaatcccgaattgttgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgccgcccaacccgacgcgcccgccgtccgtatgcgtttggcggcagcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgtcacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggcgggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctga

SEQ ID NO: 2642 - protein, 490 aa, Neisseria meningitidis
LIMVIFYFCGKTFMPARNRWMLLLPLLASAAYAEETPREPDLRSRPEFRLHEAEVKPIDREKVPGQVREKGKVLQIDGETLLKNPELLSRAMYSAVVSNNIAGIRVILPIYLQQAQQDKMLALYAQGILAQADGRVKEAISHYRELIAAQPDAPAVRMRLAAALFENRQNEAAADQFDRLKAENLPPQLMEQVELYRKALRERDAWKVNGGFSVTREHNINQAPKRQQYGKWTFPKQVDGTAVNYRLGAEKKWSLKNGWYTTAGGDVSGRVYPGNKKFNDMTAGVSGGIGFADRRKDAGLAVFHERRTYGNDAYSYTNGARLYFNRWQTPKWQTLSSAEWGRLKNTRRARSDNTHLQISNSLVFYRNARQYWMGGLDFYRERNPADRGDNFNRYGLRFAWGQEWGGSGLSSLLRLGAAKRHYEKPGFFSGFKGERRRDKELNTSLSLWHRALHFKGITPRLTLSHRETRSNDVFNEYEKNRAFVEFNKTF

SEQ ID NO: 2643 - DNA, 1473 bp, Neisseria meningitidis
ttgataatggttattttttatttttgtgggaagacatttatgcctgcacgaaacagatggatgctgctgctgcctttattggcaagcgcggcatatgccgaagaaacaccgcgcgaaccggatttgagaagccgtcccgagttcaggcttcatgaagcggaggtcaaaccaatcgacagggagaaggtaccggggcaggtgcgggaaaaaggaaaagttttgcagattgacggcgaaaccctgctgaaaaatcccgaattgctgtcccgcgcgatgtattccgcagtggtctcaaacaatattgccggtatccgcgttattttgccgatttacctacaacaggcgcagcaggataagatgttggcactttatgcacaagggattttggcgcaggcagacggtagggtgaaggaggcgatttcccattaccgggaattgattgtcgcccaacccgacgcgcccgccgtccgtatgcgtttggcggcggcattgtttgaaaacaggcagaacgaggcggcggcagaccagttcgaccgcctgaaggcggaaaacctgccgccgcagctgatggagcaggtcgagctgtaccgcaaggcattgcgcgaacgcgatgcgtggaaggtaaatggcggcttcagcgttacccgcgaacacaatatcaaccaagccccgaaacggcagcagtacggcaaatggactttcccgaaacaggtggacggcacggcggtcaattaccggctcggcgcggagaaaaaatggtcgctgaaaaacggctggtacacgacggcgggcggcgacgtgtccggcagggtttatccggggaataagaaattcaacgatatgacggcaggcgtttccggcggcatcggttttgccgaccggcgcaaagatgccgggctggcagtgttccacgaacgccgcacctacggcaacgacgcttattcttacaccaacggcgcacgcctttatttcaaccgttggcaaaccccgaaatggcaaacgttgtcttcggcggagtgggggcgtttgaagaatacgcgccgggcgcgttccgacaatacccatttgcaaatttccaattcgctggtgttttaccggaatgcgcgccaatattggatgggcggtttggatttttaccgcgagcgcaaccccgccgaccggggcgacaatttcaaccgttacggcctgcgctttgcctgggggcaggaatggggcggcagcggcctgtcttcgctgttgcgcctcggcgcggcgaaacggcattatgaaaaacccggctttttcagcggttttaaaggggaaaggcgcagggataaagaattgaacacatccttgagcctttggcaccgggcattgcatttcaaaggcatcacgccgcgcctgacgttgtcgcaccgcgaaacgcggagtaacgatgtgttcaacgaatacgagaaaaatcgggcgtttgtcgagtttaataaaacgttctga

SEQ ID NO: 2644 - protein, 490 aa, Neisseria meningitidis
LIMVIFYFCGKTFMPARNRWMLLLPLLASAAYAEETPREPDLRSRPEFRLHEAEVKPIDREKVPGQVREKGKVLQIDGETLLKNPELLSRAMYSAVVSNNIAGIRVILPIYLQQAQQDKMLALYAQGILAQADGRVKEAISHYRELIVAQPDAPAVRMRLAAALFENRQNEAAADQFDRLKAENLPPQLMEQVELYRKALRERDAWKVNGGFSVTREHNINQAPKRQQYGKWTFPKQVDGTAVNYRLGAEKKWSLKNGWYTTAGGDVSGRVYPGNKKFNDMTAGVSGGIGFADRRKDAGLAVFHERRTYGNDAYSYTNGARLYFNRWQTPKWQTLSSAEWGRLKNTRRARSDNTHLQISNSLVFYRNARQYWMGGLDFYRERNPADRGDNFNRYGLRFAWGQEWGGSGLSSLLRLGAAKRHYEKPGFFSGFKGERRRDKELNTSLSLWHRALHFKGITPRLTLSHRETRSNDVFNEYEKNRAFVEFNKTF

SEQ ID NO: 2645 - DNA, 561 bp, Neisseria gonorrhoeae
atgaacagactgctactgctgtctgccgccgtcctgccgactgcctgcggcagcggcgaaaccgataaaatcggacgggcaagtaccgttttcaacatgttgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaagcgcggtacgggcttcgcgttcaagagccggcagattgtccgttattacgaccccaaacgcaaagccttcgcctatttggtttacagcgataaaatcgtccaaggatcgccgaaaaattccttaagcgcggtttcctgtttcggcagcggcataccgcaaaccgacggggtgcaagccgatacttccggcaaactgcttgccggcgcctgcattatttccaacccgataaaaaatcccgacaaacgctga

SEQ ID NO: 2646 - protein, 186 aa, Neisseria gonorrhoeae
MNRLLLLSAAVLPTACGSGETDKIGRASTVFNMLGKNDRIEVEGFDDPDVQGVACYISYAKKGGLKEMVNLEEDASDASVSCVQTASSISFDETAVRKPKEVFKRGTGFAFKSRQIVRYYDPKRKAFAYLVYSDKIVQGSPKNSLSAVSCFGSGIPQTDGVQADTSGKLLAGACIISNPIKNPDKR

SEQ ID NO: 2647 - DNA, 561 bp, Neisseria meningitidis
atgaacagactgctactgctgtctgccgccgtcctgctgactgcctgcggcagcggcgaaaccgataaaatcggacgggcaagtaccgttttcaacatactgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaaacacggtgcgagcttcgcgttcaagagccggcagattgtccgttattacgaccccaaacgcaaaaccttcgcctatttggtgtacagcgataaaatcatccaaggctcgccgaaaaattccttaagcgcggtttcctgtttcggcggcggcataccgcaaaccgatggggtgcaagccgatacttccggcaacctgcttgccggcgcctgcatgatttccaacccgatagaaaatctcgacaaacgctga

SEQ ID NO: 2648 - protein, 186 aa, Neisseria meningitidis
MNRLLLLSAAVLLTACGSGETDKIGRASTVFNILGKNDRIEVEGFDDPDVQGVACYISYAKKGGLKEMVNLEEDASDASVSCVQTASSISFDETAVRKPKEVFKHGASFAFKSRQIVRYYDPKRKTFAYLVYSDKIIQGSPKNSLSAVSCFGGGIPQTDGVQADTSGNLLAGACMISNPIENLDKR

SEQ ID NO: 2649 - DNA, 561 bp, Neisseria meningitidis
atgaacagactgctactgctgtctgccgccgtcctgctgactgcctgcggcagcggcgaaaccgataaaatcggacgggcaagtaccgttttcaacatactgggcaaaaacgaccgtatcgaagtggaaggattcgacgatcccgacgttcaaggggttgcctgttatatttcgtatgcaaaaaaaggcggcttgaaggaaatggtcaatttggaagaggacgcgtccgacgcatcggtttcgtgcgttcagacggcatcttcgatttcttttgacgaaaccgccgtgcgcaaaccgaaagaagttttcaaacacggtgcgagcttcgcgttcaagagccggcagattgtccgttattacgaccccaaacgcaaaaccttcgcctatttggtgtacagcgataaaatcatccaaggctcgccgaaaaattccttaagcgcggtttcctgtttcggcggcggcataccgcaaaccgatggggtgcaagccgatacttccggcaacctgcttgccggcgcctgcatgatttccaacccgatagaaaatcccgacaaacgctga

SEQ ID NO: 2650 - protein, 186 aa, Neisseria meningitidis
MNRLLLLSAAVLLTACGSGETDKIGRASTVFNILGKNDRIEVEGFDDPDVQGVACYISYAKKGGLKEMVNLEEDASDASVSCVQTASSISFDETAVRKPKEVFKHGASFAFKSRQIVRYYDPKRKTFAYLVYSDKIIQGSPKNSLSAVSCFGGGIPQTDGVQADTSGNLLAGACMISNPIENPDKR

SEQ ID NO: 2651 - DNA, 2103 bp, Neisseria gonorrhoeae
atggatttattatcggttttccacaaataccgtctgaaatatgcggtggcggtgctgacgatgctgcttttggcggcagtcgggctgcacgcttccgtatatcgcaccttcacgcccgaaaacatccgcagccgcctccaacaaagcattgcccatacccaccggaaaatctcgtttgatgcggatatacggcgcaggcttctgccccgcccgaccgtcatcctgaaaaacctgaccattaccgaacccgacggcggccgggtcgccgtttccgtcaaagaaaccaaaatcggattgagctggaaaaacctgtggtcggatcggatacaggttgaaaaatgggtggtttcgggtgcggatcttgccctgacgcgcgacagaaacggcgcttggaacatccaagacctgttcgacggcgcgaaacactccgcctcagtcaaccgcattatcgtcgaaaacagcaccgtccgcctcaatttcctgcagcaacagcttatcctgaaggaaatcagcctcaacctgcaatcccccgattcgtcggggcagcagtttgaaagttcgggcatactggtttggagaaagctgtccgtcccgtggaaaagcagggggctgttcctttcagacggcatcggcacgcccgaaatctcaccgttccattttgaagcttccacttcgctggacggacacggcatcaccatttccaccaccggcagcccttctgtccgcttcaacgccggcggagcggatgccgccggcctcggcctgcgtgcagacacttccttccgcaacctccacctgaccgcgcaaatccccgcactggcactcaaaaacaacagcatcaaaaccggcacggtcaacggcacgtttaccgccggcggcgaatatgcccgatgggacggttcgttcaaactcgacaaagccaacctgcactccggcatcgccaacatcggcaacgccgaaatctccggcagcttcaaaacaccgcgccttcaaaccaatttctccctcggctcgccgttggtttggagtcgggacaacgggctggacgccccgcgcctgcacatatcgacccttcaggataccgtcgaccgcctgccgcaaccccgtttcatcagccggctcgacggttcgctgtccataccgaatctgcaaaattggaatgccgaattaaacggcacattcgaccgccaacccgttgccgcaaaattcaaatatacgcgggaaggcgcaccgcacctggaagccgccgccgcgctgcaaaaattaaacctcgccccctatcttgacgaatttcggcaacaaaacggcaaaatattccccgacatcctcggcaggctgtccggcaacgtcgaggcacacctcaaaatcggcagcatccaactccccggcttgcaactggacgatatggaaacctacctccacgccgacaaagaccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgatgcggtcatcgacctgaccgcaagcggcgaaaaccgcaaacagcttatccgctcgctgcaaggcagcctgtcgctgaatatttccaacggcgcgtggcacggcatcgatatggacagcattttaaaaaacggcctttccgggaaaatctcgggcagcacacccttctaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggtacggtggacaagccgtccattaccgtcgattacggcaggctgaccggcggcatcaattcgcgcaaagagaaacagaaaatcctcgaagacaccctgctggaacaatggcagtggctcaaacctaaagaaccgtaa

SEQ ID NO: 2652 - protein, 700 aa, Neisseria gonorrhoeae
MDLLSVFHKYRLKYAVAVLTMLLLAAVGLHASVYRTFTPENIRSRLQQSIAHTHRKISFDADIRRRLLPRPTVILKNLTITEPDGGRVAVSVKETKIGLSWKNLWSDRIQVEKWVVSGADLALTRDRNGAWNIQDLFDGAKHSASVNRIIVENSTVRLNFLQQQLILKEISLNLQSPDSSGQQFESSGILVWRKLSVPWKSRGLFLSDGIGTPEISPFHFEASTSLDGHGITISTTGSPSVRFNAGGADAAGLGLRADTSFRNLHLTAQIPALALKNNSIKTGTVNGTFTAGGEYARWDGSFKLDKANLHSGIANIGNAEISGSFKTPRLQTNFSLGSPLVWSRDNGLDAPRLHISTLQDTVDRLPQPRFISRLDGSLSIPNLQNWNAELNGTFDRQPVAAKFKYTREGAPHLEAAAALQKLNLAPYLDEFRQQNGKIFPDILGRLSGNVEAHLKIGSIQLPGLQLDDMETYLHADKDHIALSRFKSGLYGGHTEGGISIANTRPATYRLQQNASNIQIQPLLQDLFGFHSFSGNGDAVIDLTASGENRKQLIRSLQGSLSLNISNGAWHGIDMDSILKNGLSGKISGSTPFYRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 2653 - DNA, 2114 bp, Neisseria meningitidis
atggatttattatcggttttccacaaataccgtctgaaatatgcggtggccgtgctgacgatactgcttttggcggcagtcgggctgcacgcttccgtatatcgcaccttcacgcctgaaaacatccgcagccgcctacaacaaagcattgcacacacacaccggaaaatctcgtttgatgcggacattcagcgcaggctcctgccccggccgaccgtcatcctgaaaaacctgaccattaccgaacccggcggcgaccagactgccgtttccgtccaagaaaccaaaatcggattgagctggaaaaacctgtggtcggatcagatacagattgaaaaatgggtggtttcgagtgcggaacttgccctgacgcgcgacgggaaaggtgtttggaacatccaagacctgatcgacagccaaaaacgccaagcctcagtcaaccgcattatcgtcgaaaacagcaccgtccgcctcaatttcctgcaggaacagcttatcctgaaggaaatcaacctcaacctgcaatcccccgattcgtcggggcagccgtttgaaagttcgggcatactggtttggggaaagctgtccgtcccgtggaaaagcagggggctgttcctttcaaacggcatcggcccgcccgaaatctcaccgttccattttgaagcttccacttcgctggacggacacggcattaccatttccaccaccggcagcccttctgtccgcttcaacgccggcggagcggatgccgccggcctcggcctgcgtgcagacacttccttccgcaacctccacctgaccgcccaaatccccgcgctggcactcaggaacaacagcattaaaattgaaaccgtcaacggcgcatttaccgccggcggcgaatatgcccgatgggacggttcgttcaaactcgacaaagccaacctgcactccggcatcgccaacatcggcaacgccgaaatctccggcagcttcaaaacaccgcgccaccagaccaacttctccctcaattcgccgctcgtatggacggaaaacaaagggctggacgcgccgcgcctgtatgtatcgacccttcaggataccgtcaaccgcctgccgcaaccccgtttcatcagccggctcgacggttcgctgtccgtaccgaatctgcaaaattggaatgccgaattaaacggcacattcgaccgccaaaccgttgccgcgaaattcagatacacacatgaagacgcaccgcatctggaagccgccgtcgcactgcaaaaattgaacctgaccccctatcttgacgacgtgcggcaacaaaacggcaaaatatttcccgacaccctcgccaagctgtccggcgacatcgaggcgcacctgaaaatcggaaaagtccaacttcccggcctgcaactggacgatatggaaacctacctccacgccgacaaaggccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgacgcggtcatcgacctgaccgcgggcggcgaaacccgaaaagagcttatccgctcgcttcagggcagcctgtcgctaaatatttccaacggtgcatggcacggtatcgacatggacaatatcctgaaaaacggcatttcgggcaaaactgccgacaatgccgcacccagcacacccttccaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggcacggtggacaaaccgtccattaccgtcgattacggcaggctgaccggcggcatcaattcgcgcaaagagaaacagaaaatcctcgaagacaccctgctggaacaatggcagtggctcaaacctaaagaaccgta

SEQ ID NO: 2654 - protein, 704 aa, Neisseria meningitidis
MDLLSVFHKYRLKYAVAVLTILLLAAVGLHASVYRTFTPENIRSRLQQSIAHTHRKISFDADIQRRLLPRPTVILKNLTITEPGGDQTAVSVQETKIGLSWKNLWSDQIQIEKWVVSSAELALTRDGKGVWNIQDLIDSQKRQASVNRIIVENSTVRLNFLQEQLILKEINLNLQSPDSSGQPFESSGILVWGKLSVPWKSRGLFLSNGIGPPEISPFHFEASTSLDGHGITISTTGSPSVRFNAGGADAAGLGLRADTSFRNLHLTAQIPALALRNNSIKIETVNGAFTAGGEYARWDGSFKLDKANLHSGIANIGNAEISGSFKTPRHQTNFSLNSPLVWTENKGLDAPRLYVSTLQDTVNRLPQPRFISRLDGSLSVPNLQNWNAELNGTFDRQTVAAKFRYTHEDAPHLEAAVALQKLNLTPYLDDVRQQNGKIFPDTLAKLSGDIEAHLKIGKVQLPGLQLDDMETYLHADKGHIALSRFKSGLYGGHTEGGISIANTRPATYRLQQNASNIQIQPLLQDLFGFHSFSGNGDAVIDLTAGGETRKELIRSLQGSLSLNISNGAWHGIDMDNILKNGISGKTADNAAPSTPFHRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 2655 - DNA, 2115 bp, Neisseria meningitidis
atggatttattatcggtcttccacaaataccgtctgaaatatgcggtagccgtgctgacgatactgcttttggcggcaatcgggctgcacgcttccgtatatcgcatcttcacacctgaaaacatccgaagccgcctccaacaaagcattgcccatacgcaccggaaaatctcgtttgatgcggatatacagcgcaggcttctgccccggccgaccgtcatcctgaaaaacctgaccattaccgaacccggcggcgaccggactgccgtttccgtccaagaaaccaaaatcggattgagctggaaaaacctgtggtcggatcagatacagattgaaaaatgggtggtttcgagtgcggaacttgccctgacgcgcgacgggaaaggtgtttggaacatccaagacctgatcgacagccaaaaacgccaagcctcagtcaaccgcattatcgtcgaaaacagcaccgtccgcctcaatttcctgcaggaacagcttatcctgaaggaaatcaacctcaacctgcaatcccccgattcgtcggggcagccgtttgaaagttcgggcatactggtttggggaaagctgtccgtcccgtggaaaagcagggggctgttcctttcagacggcatcggcacgcccaaaatctcaccgttccattttgaagcttccacttcgctggacggacacggcattaccatttccaccaccggcagcccttctgtccgcttcaacgccggcggagcggatgccgccggcctcggcctgcgtgcagacacttccttccgcaacctccacctgaccgcccaaatccctacgctggcactcaggaacaacagcattaaaattgaaaccgtcaacggcgcatttaccgccggcggcgaatatgcccaatgggacggttcgttcaaactcgacaaagccaacctgcactccggcatcgccaacatcggcaacgccgaaatctccggcagcttcaaaacaccgcgccaccagaccaacttctccctcaattcgccgctcgtatggacggaaaacaaagggctggacgcgccgcgcctgtatgtatcgacccttcaggataccgtcaaccgcctgccgcaaccccgtttcatcagccggctcgacggttcgctgtccgtaccgaatctgcaaaattggaatgccgaattaaacggcacattcgaccgccaaaccgttgccgcgaaattcagatacacacatgaagacgcaccgcatctggaagccgccgtcgcactgcaaaaattgaacctgaccccctatcttgacgacgtgcggcaacaaaacggcaaaatatttcccgacaccctcgccaagctgtccggcgacatcgaggcgcacctgaaaatcggaaaagtccaacttcccggcctgcaactggacgatatggaaacctacctccacgccgacaaaggccatatcgcgctcagccgtttcaagtcagggctttacggcggccataccgaaggcggcatcagcatcgccaacacccgtcccgccacttaccgcctgcaacagaatgcaagcaacatccaaatccaaccgctgctgcaagacctgttcggcttccacagcttcagcggcaacggcgacgcggtcatcgacctgaccgcgggcggcgaaacccgaaaagagcttatccgctcgcttcagggcagcctgtcgctaaatatttccaacggtgcatggcacggtatcgacatggacaatatcctgaaaaacggcatttcgggcaaaactgccgacaatgccgcacccagcacacccttccaccgattcacgctcaacagcgaaatttcagacggcatcagccgccacatcgataccgaactcttctccgacagcctctatgttaccagcaacggctataccaatctggatacgcaggaattgtctgaagatgtccttatccgcaacgccgtccatccgaaaaacaaaccgattcccctgaaaatcaccggtacggtggacaaaccgtccattaccgtcgattacggcaggctgaccggcggcatcaattcgcgcaaagagaaacagaaaatcctcgaagacaccctgctggaacaatggcagtggctcaaacctaaagaaccgtaa

SEQ ID NO: 2656 - protein, 704 aa, Neisseria meningitidis
MDLLSVFHKYRLKYAVAVLTILLLAAIGLHASVYRIFTPENIRSRLQQSIAHTHRKISFDADIQRRLLPRPTVILKNLTITEPGGDRTAVSVQETKIGLSWKNLWSDQIQIEKWVVSSAELALTRDGKGVWNIQDLIDSQKRQASVNRIIVENSTVRLNFLQEQLILKEINLNLQSPDSSGQPFESSGILVWGKLSVPWKSRGLFLSDGIGTPKISPFHFEASTSLDGHGITISTTGSPSVRFNAGGADAAGLGLRADTSFRNLHLTAQIPTLALRNNSIKIETVNGAFTAGGEYAQWDGSFKLDKANLHSGIANIGNAEISGSFKTPRHQTNFSLNSPLVWTENKGLDAPRLYVSTLQDTVNRLPQPRFISRLDGSLSVPNLQNWNAELNGTFDRQTVAAKFRYTHEDAPHLEAAVALQKLNLTPYLDDVRQQNGKIFPDTLAKLSGDIEAHLKIGKVQLPGLQLDDMETYLHADKGHIALSRFKSGLYGGHTEGGISIANTRPATYRLQQNASNIQIQPLLQDLFGFHSFSGNGDAVIDLTAGGETRKELIRSLQGSLSLNISNGAWHGIDMDNILKNGISGKTADNAAPSTPFHRFTLNSEISDGISRHIDTELFSDSLYVTSNGYTNLDTQELSEDVLIRNAVHPKNKPIPLKITGTVDKPSITVDYGRLTGGINSRKEKQKILEDTLLEQWQWLKPKEP

SEQ ID NO: 2657 - DNA, 897 bp, Neisseria gonorrhoeae
gtgttcggcacggtcttgcggactgatgccgactgcctgcaaatcatcgtcgtcggcaagttctttcaggttgttgcgtatggttttgcggcgttggcggaaggcgagtttcaccagtttggcgaaatgatcgaaatcgtccgccttgccgatacggtgtttcaccggaatcatgcgcaccactgcggaatcgattttcggcgcgggatcgaacgattcgggcggcacgtcaatcagcagctccatatcgaaaaaatattgcagcatcacacccaagcgaccgtagtcgttgcttttcggcgcggcaaccatgcgctcgaccacttctttttgcaacataaagtgcatatcggcgacatcgtccgccacctccgccagtttgaacaaaagcggcgtggagatgttatacggcaggttgccgacgattttctttttgcctgagatgccgttgaaatcaaactgcaacacgtcgccttcgtgaatcaccagtttatccgcaaacggcagcgttttcagacggcatacgatgtcgcggtcgatttcgacaacgtgcaggcggttcagctttttcgccaaaggttcggtaattgccgccaaacccgggccgatttcaatcacgacatcatccgcctgcgggcgcacggcgttgacaatatcgccgataatccgcgtgtcctgcaaaaaattctgcccgaaacgcttgcgggctttgtgttctttcatcgtgtttcctcttcggttgaaaccccgccctttagggcggcaggatcagactctgtttgggcggggcgtaaccccttccaaatcaggacgacacatagggcggtgctttatgtgtcgtcctgtgtgttggaacataaatgtgtttacagtatccgtttgatgtcggcattgtaa

SEQ ID NO: 2658 - protein, 297 aa, Neisseria gonorrhoeae
VFGTVLRTDADCLQIIVVGKFFQVVAYGFAALAEGEFHQFGEMIEIVRLADTVFHRNHAHHCGIDFRRGIERFGRHVNQQLHIEKILQHHTQATVVVAFRRGNHALDHFFLQHKVHIGDIVRHLRQFEQKRRGDVIRQVADDFLFADAVEIKLQHVAFVNHQFIRKRQRFQTAYDVAVDFDNVQAVQLFRQRFGNCRQTRADFNHDIIRLRAHGVDNIADNPRVLQKILPETLAGFVFFHRVSSSVETPPFRAAGSDSVWAGRNPFQIRTTHRAVLYVSSCVLEHKCVYSIRLMSAL

SEQ ID NO: 2659 - DNA, 897 bp, Neisseria meningitidis
atgttcggcgcggtcttgcggattgatgccgactgcctgcaaatcatcgtcgcctgcaagctctttcagattgttgcgtatggttttgcggcgttggtggaaggcgagtttcacgagtttggcaaaatgctcgaaatcgtccgccttgccgatgcggtgtttcaccggaatcatacggacgacggcggaatccactttcggcgcagggtcgaacgattcgggcggtacgtcaatcagcatttccatatcgaaaaaatattgcagcatcacgcccaagcggccgtagtcgttgcttttcggcgcggcaaccatacgctcgaccacttctttttgcagcataaagtgcatatcgacgacatcgtccgccacctccgccagcttgaacaaaagcggtgtggaaatgttgtacgggaggttgccgacgattttctttttgcctgcgatgccgttgaaatcaaactgcaatacatcgccttcgtgaatcaccagtttatccgcaaacggcagcgttttcagacggcatacgatgtcgcggtcgatttcgacaacgtgcaggcggttcagctttttcgccaaaggttcggtaatcgccgccaaacccgggccgatttcaatcacgacatcatccgcctgcgggcgcacggcgttgacaatatcgctgataatccgcgtgtcctgcaaaaaattctgcccgaaacgcttgcgggctttgtgttctttcatcgtgtttccttttcggttgaaaccccgccctttagggcggtagaatcagactctatttgggaggggcgtaactctttccaaatcaggatggcacatagggcggtgctttatgtgtcgtcctgtgtgttgaaacataaatgtgtttacagtatccgtttgatgtcggcattgtaa

SEQ ID NO: 2660 - protein, 298 aa, Neisseria meningitidis
MFGAVLRIDADCLQIIVACKLFQIVAYGFAALVEGEFHEFGKMLEIVRLADAVFHRNHTDDGGIHFRRRVERFGRYVNQHFHIEKILQHHAQAAVVVAFRRGNHTLDHFFLQHKVHIDDIVRHLRQLEQKRCGNVVREVADDFLFACDAVEIKLQYIAFVNHQFIRKRQRFQTAYDVAVDFDNVQAVQLFRQRFGNRRQTRADFNHDIIRLRAHGVDNIADNPRVLQKILPETLAGFVFFHRVSFSVETPPFRAVESDSIWEGRNSFQIRMAHRAVLYVSSCVLKHKCVYSIRLMSAL

SEQ ID NO: 2661 - DNA, 897 bp, Neisseria meningitidis
atgttcggcgcggtcttgcggattgatgccgactgcctgcaaatcatcgtcgcctgcaagctctttcagattgttgcgtatggttttgcggcgttggtggaaggcgagtttcacgagtttggcgaaatgctcgaaatcgtccgccttgccgatacggtgtttcaccggaatcatgcggacgacggccgaatccactttcggcgcggggtcgaacgattcgggcggcacgtcaatcagcatttccatatcgaagaaatattgcagcatcacgcccaagcggccgtagtcgttgcttttcggcgcggcaaccatacgatcgaccacttctttttgcagcataaagtgcatatcgacgacatcgtccgccacctccgccagcttgaacaaaagcggcgtggaaatgttgtagggcaggttgccgacgattttctttttgcctgcgatgccgttgaaatcaaactgcaatacatcgccttcgtgaatcaccagtttatccgcaaacggcagcgttttcagacggcatacgatgtcgcggtcgatttcgacaacgtgcaggcggttcagctttttcgccaaaggttcggtaatcgccgccaaacccggaccgatttcaatcacgacatcatccgcctgcgggcgcacggcgttgacaatatcgctgataatccgcgtgtcctgcaaaaaattctgcccgaaacgcttgcgggctttgtgttctttcatcgtgtttccttttcggttgaaaccccgccctttagggcggtagaatcagactctatttgggaggggcgtaactccttccaaatcaggacggcacatagggcggtgctttatgtgtcgtcctgtgtgttgaaacataaatgtgtttacagtatccgtttgatgtcggcattgtaa

SEQ ID NO: 2662 - protein, 298 aa, Neisseria meningitidis
MFGAVLRIDADCLQIIVACKLFQIVAYGFAALVEGEFHEFGEMLEIVRLADTVFHRNHADDGRIHFRRGVERFGRHVNQHFHIEEILQHHAQAAVVVAFRRGNHTIDHFFLQHKVHIDDIVRHLRQLEQKRRGNVVGQVADDFLFACDAVEIKLQYIAFVNHQFIRKRQRFQTAYDVAVDFDNVQAVQLFRQRFGNRRQTRTDFNHDIIRLRAHGVDNIADNPRVLQKILPETLAGFVFFHRVSFSVETPPFRAVESDSIWEGRNSFQIRTAHRAVLYVSSCVLKHKCVYSIRLMSAL

SEQ ID NO: 2663 - DNA, 783 bp, Neisseria meningitidis
atgggattgggtgcaacgacttttgtcggttcgggtgctataggcggaggtctgtgcagtaccgggattggctgtgcggccggtggacttattgcaacggcaggtatgaccggtggttatacacaggcctcagaaggaagccggcaattgtttggcacttaccagtccgattttggtaaaaaagttgtcctatctttgggtacaccaatagaatacgaatcgccgttagtatctgatgcgaaaaatctagccgtatggggattggaaacgctgattacgcgcaaattgggaaacttggcaacgggtgtgaaaacttccttgactccgaaaactgctgacgtacagcgaaatatcctgtcccaatccgaagtcggtatcaagtggggcaaggggattgaaggacagggaatgccttgggaggattatgtcggtaagggcttgtctgccaatgcaaggttacctaaaaattttaaaacatttgattattttgatcgtggtacaggcacggcaatcagtgccaaaactctggatacgcaaactacggcacgcctgtccaaacccgaacagctttacagtaccatgaaagggtacatcgataagacggcaaatttcaaaagttatgaattatcagaagtaccgttaagggcagacatgatcaaacagcgcgaaatccatctggccatacccgcacaaactaataaggagcaaagattgcagttgcaacgtgtggtagagtatggcaaaagtcaaaacattacagtcaaaattacggagatcgaataa

SEQ ID NO: 2664 - protein, 260 aa, Neisseria meningitidis
MGLGATTFVGSGAIGGGLCSTGIGCAAGGLIATAGMTGGYTQASEGSRQLFGTYQSDFGKKVVLSLGTPIEYESPLVSDAKNLAVWGLETLITRKLGNLATGVKTSLTPKTADVQRNILSQSEVGIKWGKGIEGQGMPWEDYVGKGLSANARLPKNFKTFDYFDRGTGTAISAKTLDTQTTARLSKPEQLYSTMKGYIDKTANFKSYELSEVPLRADMIKQREIHLAIPAQTNKEQRLQLQRVVEYGKSQNITVKITEIE

SEQ ID NO: 2665 - DNA, 714 bp, Neisseria gonorrhoeae
atgaagaccaaattaccgctttttatcatttggctgtctgtgtctgcctcctgtgcttccgttttacccgttccggagggcagccgaaccgaaatgccgacacaggaaaatgcttcagacggcattccctatcccgttcccactctgcaagaccgtttggactatctggaaggcaaaatcgtccggctgtcgaacgaagtggaaatgttaaacgggaaagtcaaagcattggagcatacgaaaatacacccttccggcaggacatacgtccaaaaactcgacgaccgcaaattgaaagagcattacctcaataccgaaggcggcagcgcatccgcacataccgtcgaaaccgcacaaaacctctacaatcaggcactcaaacactatcaaaacggcaggttttctgccgcagccgccttgttgaagggggcggacggcggagacggcggcagcatcgcgcaacgcagtatgtacctgttgctgcaaagcagggcgcgtatggggaactgtgaatctgtcatcgaaatcggagggcgttacgccaaccgtttcaaagacagcccaaccgcgcccgaagtcatattcaaaatcggcgaatgccaatacaggcttcagcaaaaagacattgcaagggcgacttggcgcagcctgatacagacctatcccggcagcccggcggcaaaacgcgccgccgcagccgtacgcaaacgatag

SEQ ID NO: 2666 - protein, 237 aa, Neisseria gonorrhoeae
MKTKLPLFIIWLSVSASCASVLPVPEGSRTEMPTQENASDGIPYPVPTLQDRLDYLEGKIVRLSNEVEMLNGKVKALEHTKIHPSGRTYVQKLDDRKLKEHYLNTEGGSASAHTVETAQNLYNQALKHYQNGRFSAAAALLKGADGGDGGSIAQRSMYLLLQSRARMGNCESVIEIGGRYANRFKDSPTAPEVIFKIGECQYRLQQKDIARATWRSLIQTYPGSPAAKRAAAAVRKR

SEQ ID NO: 2667 - DNA, 714 bp, Neisseria meningitidis
atgaagatcaaattaccgctttttatcatttggctgtctgtgtccgcctcctgtgcttccgtttcacccgttccggcaggcagccaaaccgaaatgtcgacacgggaaaatgcttcagacggcattccctatcccgttccgaccttgcaagaccgtttggactatctggaaggcaaaatcgtccggctgtcgaacgaagtggaaaccttaaacggcaaagtcaaagcactggaacacgcaaaaacacattcttccggcagggcatacgtccaaaaactcgacgaccgcaagttgaaagagcattacctcaataccgaaggcggcagcgcatccgcacatactgtcgaaaccgcacaaaacctctacaatcaggcactcaaacactataaaagcggcaagttttctgccgctgcctccctgttgaaaggcgcggacggaggcgacggcggcagcatcgcgcaacgcagtatgtacctgttgctgcaaagcagggcgcgtatgggcaactgcgaatccgtcatcgaaatcggagggcgttacgccaaccgtttcaaagacagcccaaccgcgcctgaagccatgttcaaaatcggcgaatgccaatacaggcttcagcaaaaagacattgcaagggcgacttggcgcagcctgatacagacctatcccggcagcccggcggcaaaacgcgccgccgcagccgtgcgcaaacgatag

SEQ ID NO: 2668 - protein, 237 aa, Neisseria meningitidis
MKIKLPLFIIWLSVSASCASVSPVPAGSQTEMSTRENASDGIPYPVPTLQDRLDYLEGKIVRLSNEVETLNGKVKALEHAKTHSSGRAYVQKLDDRKLKEHYLNTEGGSASAHTVETAQNLYNQALKHYKSGKFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 2669 - DNA, 717 bp, Neisseria meningitidis
atgaagaccaaattaccgctttttatcatttggctgtccgtatccgccgcctgttcttcccctgtttcccgcaatattcaggatatgcggctcgaaccgcaggcagaggcaggtagttcggacgctattccctatcccgttcccactctgcaagaccgtttggattatctggaaggcacactcgtccgcctgtcgaacgaagtggaaaccttaaacggcaaagtcaaagcactggagcatgcgaaaacacacccttccagcagggcatacgtccaaaaactcgacgaccgcaagttgaaagagcattacctcaataccgaaggcggcagcgcatccgcacataccgtcgaaaccgcacaaaacctctacaatcaggcactcaaacactataaaagcggcaggttttctgccgctgcctccctgttgaaaggcgcggacggaggcgacggcggcagcatcgcgcaacgcagtatgtacctgttgctgcaaagcagggcgcgtatgggcaactgcgaatccgtcatcgaaatcggagggcgttacgccaaccgtttcaaagacagcccaaccgcgcctgaagccatgttcaaaatcggcgaatgccaatacaggcttcagcaaaaagacattgcaagggcgacttggcgcagcctgatacagacctatcccggcagcccggcggcaaaacgcgccgccgcagccgtgcgcaaacgatag

SEQ ID NO: 2670 - protein, 238 aa, Neisseria meningitidis
MKTKLPLFIIWLSVSAACSSPVSRNIQDMRLEPQAEAGSSDAIPYPVPTLQDRLDYLEGTLVRLSNEVETLNGKVKALEHAKTHPSSRAYVQKLDDRKLKEHYLNTEGGSASAHTVETAQNLYNQALKHYKSGRFSAAASLLKGADGGDGGSIAQRSMYLLLQSRARMGNCESVIEIGGRYANRFKDSPTAPEAMFKIGECQYRLQQKDIARATWRSLIQTYPGSPAAKRAAAAVRKR

SEQ ID NO: 2671 - DNA, 1029 bp, Neisseria meningitidis
atggcaagaaggtcaaaaacatttgaagaagctgctgctgaggttgaggaacgtttcggtcatcgtggcattaagttggtcgagtttgagggtacagccaagccgtgtgtaatcaactgccctaaacatggaaaccaaacctgttcgaggtactccaatatgttcataggaagtagctggggttgcccctcttgtggtaatgagcaagctgcaaaagccggtatagcgacccttaggaagaatcacatagcgttagaaatgctgaaacaggctgtaacaggtatgaccaagcaagagcgcatcacgacgcaagcctacaatgagatgaccaaatccgtggcaggttcaaacagcatagtccttaacgatgtccaaggcgatacgaccatcaacaaccatcatacgcatacgcacaaccacagcgatgccgatggcaaagcactgtcgatgaggctcacaccccgtcctttgttgtcagaccgtcaggcggcggctttcgcccgtacaggcaaactcacgggcagtttcgacctgtttgcttcggtggtcgccccctcgcagtacacgtttgccgttgccatgcccgacacgtccatgtcgccggttatcgaaaagggagacttgctggtggtcgagccgcgtatgtgccctgcggacgaagacatcgcgctgattgaactgtccgacaagcggctggtcgtcgcgcaccttgttatcgatattgcgggcaggatgctgatttatcagacgggcaggccgtctgaagcctttgacctgcccgaaggcagcacgattttaggtgtggtgctggagtcaaaaaacggtttatgtccgccgcacaggcaagaaggcgtgttgattcggattaccgcccctgatgtgtggacggttggtatgatttccgcttccaaaacgtcgtgtacgcgcccgaccgcagcccggaaatcagccgtatgctttcttcgattttggcaggctacgcgtgggataccgaaaacccgttcgtggcgaaatccgaacaacgcctga

SEQ ID NO: 2672 - protein, 342 aa, Neisseria meningitidis
MARRSKTFEEAAAEVEERFGHRGIKLVEFEGTAKPCVINCPKHGNQTCSRYSNMFIGSSWGCPSCGNEQAAKAGIATLRKNHIALEMLKQAVTGMTKQERITTQAYNEMTKSVAGSNSIVLNDVQGDTTINNHHTHTHNHSDADGKALSMRLTPRPLLSDRQAAAFARTGKLTGSFDLFASVVAPSQYTFAVAMPDTSMSPVIEKGDLLVVEPRMCPADEDIALIELSDKRLVVAHLVIDIAGRMLIYQTGRPSEAFDLPEGSTILGVVLESKNGLCPPHRQEGVLIRITAPDVWTVGMISASKTSCTRPTAARKSAVCFLRFWQATRGIPKTRSWRNPNNA

SEQ ID NO: 2673 - DNA, 1029 bp, Neisseria meningitidis
atggcaagaaggtcaaaaacatttgaagaagctgctgctgaggttgaggaacgtttcggtcatcgtggcattaagttggtcgagtttgagggtacagccaagccgtgtgtaatcaactgccctaaacatggaaaccaaacctgttcgaggtactccaatatgttcataggaagtagctggggttgcccctcttgtggtaatgagcaagctgcaaaagccggtatagcgacccttaggaagaatcacatagcgttagaaatgctgaaacaggctgtaacaggtatgaccaagcaagagcgcatcacgacgcaagcctacaatgagatgaccaaatccgtggcaggttcaaacagcataatccttaacgatgtccaaggcgatacgaccatcaacaaccatcatacgcatacgcacaaccacagcgatgccgacggcaaagcactgtcgatgaggctcacaccccgtcctttgttgtcagaccgtcaggcggcggctttcgcccgtacaggcaaactcacgggcagtttcgacctgtttgcttcggtggtcgccccttcacaatatacgtttgccgttgccatgcccgacacgtccatgtcgccggttatcgaaaagggggatttgctggtggtcgagccgcgtatgcgccctgcggacgaagacatcgtactgattgaactgtccgacaagcggctggtcgtcgcgcaccttgttatcgatattgcgggcaggatgctgatttatcagacgggcaggccgtctgaagccctcgacctgcccgaaggcagcgtgattttaggtgtggtgctggagtcaaaaaacggtttatgtccgccgcacaggcaagaaggcgtgttgattcggattaccgcccctgatgtgtggacggttggtacgatttccgcttccaaaacgtcgtgtacgcgcccgaccgcagcccggaaatcagccgtatgctttcttcgattttggcaggctacgcgtgggataccgaaaacccgttcgtggcgaaatccgaacaacgcctgt

SEQ ID NO: 2674 - protein, 343 aa, Neisseria meningitidis
MARRSKTFEEAAAEVEERFGHRGIKLVEFEGTAKPCVINCPKHGNQTCSRYSNMFIGSSWGCPSCGNEQAAKAGIATLRKNHIALEMLKQAVTGMTKQERITTQAYNEMTKSVAGSNSIILNDVQGDTTINNHHTHTHNHSDADGKALSMRLTPRPLLSDRQAAAFARTGKLTGSFDLFASVVAPSQYTFAVAMPDTSMSPVIEKGDLLVVEPRMRPADEDIVLIELSDKRLVVAHLVIDIAGRMLIYQTGRPSEALDLPEGSVILGVVLESKNGLCPPHRQEGVLIRITAPDVWTVGTISASKTSCTRPTAARKSAVCFLRFWQATRGIPKTRSWRNPNNAC

SEQ ID NO: 2675 - DNA, 2418 bp, Neisseria gonorrhoeae
atggtaaattattattcagctatgattaaaaagattttaactacttgttttggtttgttttttggtttttgtgtatttggagtgggtctggttgccattgctattttggtaacgtatccgaaactgccgtctttggattctttgcagcattaccagcctaaaatgccgttgactatttattcggcggatggagaagtcatcggtatgtatggggagcagcggcgcgaatttacaaaaatcggcgatttccccgaggtgttgcggaatgcggttattgccgccgaggataaacgcttttaccggcattggggggtggatgtttggggtgttgcccgcgctgccgtcggcaatgtcgtgtccggcagcgtgcagtcgggtgcgagtacgattacacagcaggtggcgaaaaatttttatttgagcagtgaaaaaacgttcacacgcaaattcaatgaggtgttgcttgcctataaaatcgagcagtctttaagcaaagacaaaatccttgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccggagcgtgccaagttgcgccagaagtatattttgaacaatatgctcgaggagaagatgattaccgtgcaacagcgcgatcaggcattgaatgaggaactgcattatgagcggtttgttcggaaaatcgatcagagtgctttatatgtggcggaaatggtgcgtcgggaactgtatgagaaatatggtgaagatgcctatacgcagggttttaaggtttataccacggtccgcaccgatcatcagaaggcggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgttactaaaaagaaaaatgtcgtcatacagctgcccggcggcaggcgggttgcgcttgacaggcgcgccttgggttttgcggcccgagcggtcgataatgagaaaatgggggaggaccgtatccgcaggggcgcggtcatccgtgtcaaaaacaacggcgggcgttgggcggtggttcaagagccgttgctgcagggggctttggtttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggccgtccgagctgccggcaagcctgtctatggctttaggtacgggcgagacgacgccgttgaaagtggcggaggcatatagtgtatttgcgaacggcggatatagggtttcttcgcacgtgatcgataagatttatgacagagacggcaggttgcgcgcccaaatgcaacctttggtggcagggcaaaatgcgcctcaggcaatcgatccgcgcaatgcctatattatgtataagattatgcaggatgtggtccgtgtcggtacggcaaggggggcagctgcgttgggaagaacggatattgccggtaaaacgggtacgaccaacgacaataaagatgcgtggtttgtcggttttaaccctgatgtggttactgccgtatatatcggcttcgacaaacctaagagtatggggcgtgccggctacggcggtacgattgcggtgccggtttgggtggactatatgcgttttgcgttgaaaggaaagcagggcaaagggatgaaaatgcctgaaggtgtggtcagcagcaatggcgaatactatatgaaggaacgtatggtaaccgatccgggcttgatgctggacaacagcggtattgcgccgcaaccttcccgacgggcaaaagaagatgatgaagcggcagtagaaaacgaacagcagggaaggtctgacgaaacgcgtcaggacgtacaggaaacgccggtgcttccgagcaatacggattccaaacagcagcagttggattccctgttttaa

SEQ ID NO: 2676 - protein, 800 aa, Neisseria gonorrhoeae
MVNYYSAMIKKILTTCFGLFFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRRELYEKYGEDAYTQGFKVYTTVRTDHQKAATEALRKALRNFDRGSSYRGAENYIDLSKSEDVEETVSQYLSGLYTVDKMVPAVVLDVTKKKNVVIQLPGGRRVALDRRALGFAARAVDNEKMGEDRIRRGAVIRVKNNGGRWAVVQEPLLQGALVSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRPSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRAGYGGTIAVPVWVDYMRFALKGKQGKGMKMPEGVVSSNGEYYMKERMVTDPGLMLDNSGIAPQPSRRAKEDDEAAVENEQQGRSDETRQDVQETPVLPSNTDSKQQQ

SEQ ID NO: 2677 - DNA, 2418 bp, Neisseria meningitidis
atggtaaattattattcagctatgattaaaaagattttaacgacttgttttggtttggtttttgggttttgtgtatttggagtgggtttggttgccattgctattttggtaacgtatccgaaactgccgtctttggattctttgcagcattaccagcctaaaatgccgttgactatttattcggcggatggggaagtcatcggtatgtatggggagcagcggcgcgaatttacaaaaatcggcgatttcccagaggtgttgcggaatgcggttatcgccgccgaggataaacgcttttaccggcattggggggtggatgtttggggtgttgcccgcgctgccgtcggcaatgtcgtgtccggcagcgtgcagtcgggtgcgagtacgattacgcagcaggtggcgaaaaatttttatttgagcagtgaaaaaacgttcacacgcaaattcaatgaggtgttgcttgcctataaaatcgagcagtctttaagcaaagacaaaatcctcgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccagaacgtgccaagttgcgccagaagtatattttgaacaatatgctcgaggagaagatgattaccgtgcaacagcgcgatcaggcgttgaatgaggaactgcattacgagcggtttgttcggaaaatcgatcagagtgcgttatatgtggcggaaatggtgcgtcaggaactgtatgagaaatacggtgaagatgcctatacgcagggttttaaggtttataccacggtccgcgccgatcatcagaaggtggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgtgactaaaaagaaaaatgtcgtcatacagctgcccggcggcaggcgggttacgcttgacaggcgcgccttgggttttgcggcccgcgcggtcaataatgaaaaaatgggggaggaccgtatccgcaggggcgcggtcatccgtgtcaaaaacaacggcgggcgttgggcggtggttcaagagccgttgctgcagggggctttgggttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggtcgtccgagctgccggcaagcctgtctatggctttaggtacgggcgagacaacgccgttgaaagtggcggaggcatatagcgtatttgcgaacggcggatatagggtttcttcgcacgtaatcgataagatttatgacagagacggcaggttgcgcgcccaaatgcaacctttggtggctgggcaaaatgcgcctcaggcaatcgatccgcgcaatgcctatattatgtataagattatgcaggatgtggtccgtgttggtacggcaaggggggcagctgcgttgggaagaacggatattgccggtaaaacgggtacgaccaatgacaataaggatgcgtggtttgtcggttttaaccctgatgtggttactgccgtatatatcggcttcgacaaacctaagagtatggggcgtgtcggctacggcggtacgattgcggtgccggtttgggtggactatatgcgttttgcgttgaaaggaaagcagggcaaggggatgaaaatgcctgaaggtgtggtcagcagcaatggcgaatactatatgaaggaacgtatggtaaccgatccgggcttgacgctggacaacagcggtattgcgccgcaaccttcccgacgggcaaaagaagatgacgggggcgcggcagaaggcggacggcaggcggcggatgacgaagtccgccaagatatgcaggaaacgccggtgcttccgagtaatactggttccaaacagcagcagttggattctctgttttaa

SEQ ID NO: 2678 - protein, 805 aa, Neisseria meningitidis
MVNYYSAMIKKILTTCFGLVFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRQELYEKYGEDAYTQGFKVYTTVRADHQKVATEALRKALRNFDRGSSYRGAENYIDLSKSEDVEETVSQYLSGLYTVDKMVPAVVLDVTKKKNVVIQLPGGRRVTLDRRALGFAARAVNNEKMGEDRIRRGAVIRVKNNGGRWAVVQEPLLQGALGSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRSSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRVGYGGTIAVPVWVDYMRFALKGKQGKGMKMPEGVVSSNGEYYMKERMVTDPGLTLDNSGIAPQPSRRAKEDDGGAAEGGRQAADDEVRQDMQETPVLPSNTGSKQQQLDSLF

SEQ ID NO: 2679 - DNA, 2420 bp, Neisseria meningitidis
asatggtaaattattattcagctatgattaaaaagattttaacgacttgttttggtttggtttttgggttttgtgtatttggagtgggtttggttgccattgctattttggtaacgtatccgaaactgccgtctttggattctttgcagcattaccagcctaaaatgccgttgactatttattcggcggatggggaagtcatcggtatgtatggggagcagcggcgcgaatttacaaaaatcggcgatttcccagaggtgttgcggaatgcggttatcgccgccgaggataaacgcttttaccggcattggggggtggatgtttggggtgttgcccgcgctgccgtcggcaatgtcgtgtccggcagcgtgcagtcgggtgcgagtacgattacgcagcaggtggcgaaaaatttttatttgagcagtgaaaaaacgttcacacgcaaattcaatgaggtgttgcttgcctataaaatcgagcagtctttaagcaaagacaaaatcctcgagttgtatttcaatcagatttacctcggtcagcgcgcctatggttttgcatctgccgcgcaaatctatttcaataagaatgtccgagatttgactttggcggaagccgccatgcttgcgggactgcccaaggctccgtctgcctataatccgattgttaatccagaacgtgccaagttgcgccagaagtatattttgaacaatatgctcgaggagaagatgattaccgtgcaacagcgcgatcaggcgttgaatgaggaactgcattacgagcggtttgttcggaaaatcgatcagagtgctttatatgtggcggaaatggtgcgtcaggaactgtatgagaaatacggtgaagatgcctatacgcagggttttaaggtttataccacggtccgcgccgatcatcagaaggtggcaaccgaggcattgcgcaaggctctacggaatttcgatcgcggcagcagctaccgcggtgcggaaaactatatcgatttgagtaagagtgaagatgtcgaggagactgtcagccagtatctgtcgggactctataccgtcgataaaatggttcccgccgttgtgttggatgtgactaaaaagaaaaatgtcgtcatacagctgcccggcggcaggcgggttacgcttgacaggcgcgccttgggttttgcggcccgcgcggtcaataatgaaaaaatgggggaggaccgtatccgcaggggcgcggtcatccgtgtcaaaaacaacggcgggcgttgggcggtggttcaagagccgttgctgcagggggctttggtttcgctggatgcaaaaaccggagctgtgcgcgcgctggtcggcggttatgattttcacagcaaaacattcaatcgtgccgttcaggcaatgcggcagccgggttcgacctttaagccgtttgtctattcggcggcattatctaaggggatgaccgcgtccacagtggttaacgatgcgccgatttccctgccggggaaagggccgaacggttcggtttggacacctaaaaattcagacggcagatattccggctacattactttgagacaggctctgacggcttccaagaatatggtttccatccgtattttgatgtctatcggtgtcggttacgcgcaacagtatatccggcgtttcggcttcaggtcgtccgagctgccggcaagcctgtctatggctttaggtacgggcgagacaacgccgttgaaagtggcggaggcatatagcgtatttgcgaacggcggatatagggtttcttcgcacgtaatcgataagatttatgacagagacggcaggttgcgcgcccaaatgcaacctttggtggccgggcaaaatgcgcctcaggcaatcgatccgcgcaatgcctatattatgtataagattatgcaggatgtggtccgtgttggtacggcaaggggggcagctgcgttgggaagaacggatattgccggtaaaacgggtacgaccaatgacaataaggatgcgtggtttgtcggttttaaccctgatgtggttactgccgtatatatcggcttcgacaaacctaagagtatggggcgtgtcggctacggcggtacgattgcggtgccggtttgggtggactatatgcgttttgcgttgaaaggaaagcagggcaaggggatgaaaatgcctgaaggtgtggtcagcagcaatggcgaatactatatgaaggaacgtatggtaaccgatccgggcttgacgctggacaacagcggtattgcgccgcaaccttcccgacgggcaaaagaagatgacgggggcgcggcagaaggcggacggcaggcggcggatgacgaagtccgccaagatatgcaggaaacgccggtgcttccgagtaatactggttccaaacagcagcagttggattctctgttttaa

SEQ ID NO: 2680 - protein, 805 aa, Neisseria meningitidis
MVNYYSAMIKKILTTCFGLVFGFCVFGVGLVAIAILVTYPKLPSLDSLQHYQPKMPLTIYSADGEVIGMYGEQRREFTKIGDFPEVLRNAVIAAEDKRFYRHWGVDVWGVARAAVGNVVSGSVQSGASTITQQVAKNFYLSSEKTFTRKFNEVLLAYKIEQSLSKDKILELYFNQIYLGQRAYGFASAAQIYFNKNVRDLTLAEAAMLAGLPKAPSAYNPIVNPERAKLRQKYILNNMLEEKMITVQQRDQALNEELHYERFVRKIDQSALYVAEMVRQELYEKYGEDAYTQGFKVYTTVRADHQKVATEALRKALRNFDRGSSYRGAENYIDLSKSEDVEETVSQYLSGLYTVDKMVPAVVLDVTKKKNVVIQLPGGRRVTLDRRALGFAARAVNNEKMGEDRIRRGAVIRVKNNGGRWAVVQEPLLQGALVSLDAKTGAVRALVGGYDFHSKTFNRAVQAMRQPGSTFKPFVYSAALSKGMTASTVVNDAPISLPGKGPNGSVWTPKNSDGRYSGYITLRQALTASKNMVSIRILMSIGVGYAQQYIRRFGFRSSELPASLSMALGTGETTPLKVAEAYSVFANGGYRVSSHVIDKIYDRDGRLRAQMQPLVAGQNAPQAIDPRNAYIMYKIMQDVVRVGTARGAAALGRTDIAGKTGTTNDNKDAWFVGFNPDVVTAVYIGFDKPKSMGRVGYGGTIAVPVWVDYMRFALKGKQGKGMKMPEGVVSSNGEYYMKERMVTDPGLTLDNSGIAPQPSRRAKEDDGGAAEGGRQAADDEVRQDMQETPVLPSNTGSKQQQLDSLF

SEQ ID NO: 2681 - DNA, 768 bp, Neisseria gonorrhoeae
atgttccgcatcgtcaaatggctgattgccctgcccgtcggcatctttatctttttcaatgcctatgtgtacggcaacatcatcacctaccgcgccgtcgcgccccatcggactgcctttatgtcgatgcggatgaagcagtttgaacaagaaggtcgcgatgtcgcactggattaccgctgggtgccctacaaccgcatttccaccaacctgaaaaaagccctgattgcttccgaagatgtccgttttgccggacacgggggcttcgatggggacggcattcaaaacgccatcaggcgcaaccggaacagcggcgaagtgaaggcgggcggatcgaccatcagccagcagcttgccaaaaacctcttcctcaacgaaagccgcaactatctgcgcaaaggggaagaggcggccattacggcaatgatggaagctgttaccgacaaaaacaggattttcgaactgtatttaaactcaatcgaatggcactacggcgttttcggcgcggaagctgcgtcccggtatttttataaaaaaccggccgcagacctgaccaaacagcaggcggcgaaactgacggtactcgtccccgccccgttttactactctgaccatccaaaaagcaaacggctgcgcaacaaaaccaatatcgtgctcagacgcatgggttcggcaaattaccccaaagcgaaacggactgattgttccagatatggaaatgccgcctgaactggggttcgaacggcatatgttttctgggacttataa

SEQ ID NO: 2682 - protein, 254 aa, Neisseria gonorrhoeae
MFRIVKWLIALPVGIFIFFNAYVYGNIITYRAVAPHRTAFMSMRMKQFEQEGRDVALDYRWVPYNRISTNLKKALIASEDVRFAGHGGFDGDGIQNAIRRNRNSGEVKAGGSTISQQLAKNLFLNESRNYLRKGEEAAITAMMEAVTDKNRIFELYLNSIEWHYGVFGAEAASRYFYKKPAADLTKQQAAKLTVLVPAPFYYSDHPKSKRLRNKTNIVLRRMGSANYPKAKRTDCSRYGNAATGVRTAYVFWDL

SEQ ID NO: 2683 - DNA, 702 bp, Neisseria meningitidis
atgttccgcatcatcaaatggctgattgccctgcccgtcggcatctttatctttttcaatgcctatgtgtacggcaacatcattacctaccgcgccgtcgcgccccatcggactgcctttatgtcgatgcggatgaagcagtttgaacaggaaggtcgcgatgtcgcactggattaccgctggatgccctacaaacgcatttccaccaacctgaaaaaagccctgattgcttccgaagatgcccgtttcgccgggcacggcggcttcgattggggcggcattcaaaacgccatcaggcgcaaccggaacagcggcaaagtgaaggcgggcggctcgaccatcagccagcagcttgccaaaaacctgtttttaaacgaaagccgcagctatatccgcaaaggcgaagaagcggcgattaccgcgatgatggaagccgttaccgacaaagacaggatttttgaactgtatttaaactcaatcgaatggcactacggcgttttcggcgcggaagccgcgtcccggtatttttatcaaatacccgccgccaagctgaccaaacagcaggcggcaaaactgacggcgcgcgtccccgccccgctctactacgccgaccatccgaaaagcaaacggctccgcaacaaaaccaatatcgtgctcaaacgcatgggttcggcagagttgcctgaaagcgacacggactga

SEQ ID NO: 2684 - protein, 233 aa, Neisseria meningitidis
MFRIIKWLIALPVGIFIFFNAYVYGNIITYRAVAPHRTAFMSMRMKQFEQEGRDVALDYRWMPYKRISTNLKKALIASEDARFAGHGGFDWGGIQNAIRRNRNSGKVKAGGSTISQQLAKNLFLNESRSYIRKGEEAAITAMMEAVTDKDRIFELYLNSIEWHYGVFGAEAASRYFYQIPAAKLTKQQAAKLTARVPAPLYYADHPKSKRLRNKTNIVLKRMGSAELPESDTD

SEQ ID NO: 2685 - DNA, 702 bp, Neisseria meningitidis
atgttccgcatcatcaaatggctgattgccctgcccgtcggcatctttatctttttcaatgcctatgtgtacggcaacatcattacctaccgcgccgtcgcgccccatcggactgcctttatgtcgatgcggatgaagcagtttgaacaggaaggtcgcgatgtcgcactggattaccgctggatgccctacaaacgcatttccaccaacctgaaaaaagccctgattgcttccgaagatgcccgtttcgccgggcacggcggcttcgattggggcggcattcaaaacgccatcaggcgcaaccggaacagcggcaaagtgaaggcgggcggctcgaccatcagccagcagcttgccaaaaacctgtttttaaacgaaagccgcagctatatccgcaaaggcgaagaagcggcgattaccgcgatgatggaagccgttaccgacaaagacaggatttttgaactgtatttaaactcaatcgaatggcactacggcgttttcggcgcggaagccgcgtcccggtatttttatcaaatacccgccgccaagctgaccaaacagcaggcggcaaaactgacggcgcgcgtccccgccccgctctactacgccgaccatccgaaaagcaaacggctccgcaacaaaaccaatatcgtgctcagacgcatgggttcggcagagttgcctgaaagcgacacggactga

SEQ ID NO: 2686 - protein, 233 aa, Neisseria meningitidis
MFRIIKWLIALPVGIFIFFNAYVYGNIITYRAVAPHRTAFMSMRMKQFEQEGRDVALDYRWMPYKRISTNLKKALIASEDARFAGHGGFDWGGIQNAIRRNRNSGKVKAGGSTISQQLAKNLFLNESRSYIRKGEEAAITAMMEAVTDKDRIFELYLNSIEWHYGVFGAEAASRYFYQIPAAKLTKQQAAKLTARVPAPLYYADHPKSKRLRNKTNIVLRRMGSAELPESDTD

SEQ ID NO: 2687 - DNA, 1749 bp, Neisseria gonorrhoeae
atgttgattaaaagcgaatataagccccggatgctgcccaaagaagagcaggtcaaaaagccgatgaccagtaacggacggattagcttcgtcctgatggcaatggcggtcttgtttgcctgtctgattgcccgcgggctgtatctgcagacggtaacgtataactttttgaaagaacagggcgacaaccggattgtgcggactcaagcattgccggctacacgcggtacggtttcggaccggaacggtgcggttttggcgttgagcgcgccgacggagtccctgtttgccgtgcctaaagatatgaaggaaatgccgtctgccgcccaattggaacgcctgtccgagcttgtcgatgtgccggtcgatgttttgaggaacaaactcgaacagaaaggcaagtcgtttatttggatcaagcggcagctcgatcccaaggttgccgaagaggtcaaagccttgggtttggaaaactttgtatttgaaaaagaattaaaacgccattacccgatgggcaacctgtttgcacacgtcatcggatttaccgatattgacggcaaaggtcaggaaggtttggaactttcgcttgaagacagcctgtatggcgaagacggcgcggaagttgttttgcgggaccggcagggcaatattgtggacagcttggactccccgcgcaataaagcaccgcaaaacggcaaagacatcatcctttccctcgatcagaggattcagaccttggcctatgaagagttgaacaaggcggtcgaataccatcaggcaaaagccggaacggtggtggttttggatgcccgcacgggggaaatcctcgccttggccaatacgcccgcctacgatcccaacagacccggccgggcagacagcgaacagcggcgcaaccgtgccgtaaccgatatgatcgaacctggttcggcaatcaaaccgttcgtgattgcgaaggcattggatgcgggcaaaaccgatttgaacgaacggctgaatacgcagccttataaaatcggaccgtctcccgtgcgcgatgatacccatgtttacccctctttggatgtgcgcggcattatgcagaaatcgtccaacgtcggcacaagcaaactgtctgcgcgtttcggcgccgaagaaatgtatgacttctatcatgaattgggcatcggtgtgcgtatgcactcgggctttccgggggaaactgcaggtttgttgagaaattggcgcaggtggcggcccatcgaacaggcgacgatgtctttcggttacggtctgcaattgagcctgctgcaattggcgcgcgcctataccgcactgacgcacgacggcgttttgctgccgctcagctttgagaagcaggcggttgcgccgcaaggcaaacgcatattcaaagaatcgaccgcgcgcgaggtacgcaatctgatggtttccgtaaccgagccgggcggcaccggtacggcgggtgcggtggacggtttcgatgtcggcgctaaaaccggcacggcgcgcaagttcgtcaacgggcgttatgccgacaacaaacacgtcgctacctttatcggttttgcccccgccaaaaacccccgtgtgattgtggcggtaaccatcgacgaaccgactgcccacggctattacggcggcgtagtggcagggccgcccttcaaaaaaattatgggcggcagcctgaacatcttgggcatttccccgaccaagccactgaccgccgcagccgtcaaaacaccgtcttaa

SEQ ID NO: 2688 - protein, 582 aa, Neisseria gonorrhoeae
MLIKSEYKPRMLPKEEQVKKPMTSNGRISFVLMAMAVLFACLIARGLYLQTVTYNFLKEQGDNRIVRTQALPATRGTVSDRNGAVLALSAPTESLFAVPKDMKEMPSAAQLERLSELVDVPVDVLRNKLEQKGKSFIWIKRQLDPKVAEEVKALGLENFVFEKELKRHYPMGNLFAHVIGFTDIDGKGQEGLELSLEDSLYGEDGAEVVLRDRQGNIVDSLDSPRNKAPQNGKDIILSLDQRIQTLAYEELNKAVEYHQAKAGTVVVLDARTGEILALANTPAYDPNRPGRADSEQRRNRAVTDMIEPGSAIKPFVIAKALDAGKTDLNERLNTQPYKIGPSPVRDDTHVYPSLDVRGIMQKSSNVGTSKLSARFGAEEMYDFYHELGIGVRMHSGFPGETAGLLRNWRRWRPIEQATMSFGYGLQLSLLQLARAYTALTHDGVLLPLSFEKQAVAPQGKRIFKESTAREVRNLMVSVTEPGGTGTAGAVDGFDVGAKTGTARKFVNGRYADNKHVATFIGFAPAKNPRVIVAVTIDEPTAHGYYGGVVAGPPFKKIMGGSLNILGISPTKPLTAAAVKTPS

SEQ ID NO: 2689 - DNA, 1746 bp, Neisseria meningitidis
atgttgattaagagcgaatataagcctcggatgctgcccaaagaagagcaggtcaaaaagccgatgaccagtaacggacggatcagcttcgtcctgatggcaatagcggtcttgtttgccggtctgattgctcgcggactgtatctgcagacggtaacgtataactttttgaaagaacagggcgacaaccggattgtgcggactcaaacattgccggctacacgcggtacggtttcggaccggaacggtgcggttttggcgttgagtgcgccgacggagtccctgtttgccgtgcctaaagagatgaaggaaatgccgtctgccgcacaattggaacgcctgtccgagcttgtcgatgtgccggttgatgttttgaggaacaagctcgaacagaaaggcaagtcgtttatctggattaagcggcagctcgatcccaaggttgccgaagaggtcaaagccttgggtttggaaaactttgtatttgaaaaagaattaaaacgccattacccgatgggcaacctgtttgcacacgtcatcggatttaccgatattgacggcaaaggtcaggaaggtttggaactttcgcttgaagacagcctgcatggcgaagacggcgcggaagtcgttttgcgggaccggcagggcaatattgtggacagcttggactccccgcgcaataaagccccgaaaaacggcaaagacatcatcctttccctcgatcagaggattcagaccttggcctatgaagagttgaacaaggcggtcgaataccatcaggcaaaagccggaacggtggtggttttggatgcccgcacgggggaaatcctcgccttggccaatacgcccgcctacgatcccaacaggcccggccgggcagacagcgaacagcggcgcaaccgtgccgtaaccgatatgatcgaacccggttcggcaatcaaaccgtttgtgattgcgaaggcattggatgcgggcaaaaccgatttgaacgaacggctgaatacgcagccttataaaatcggaccgtctcccgtgcgcgatacccatgtttacccctctttggatgtgcgcggcatcatgcagaaatcgtccaacgtcggcacaagcaaactgtctgcgcgtttcggtgccgaagaaatgtatgacttctatcatgagttgggcatcggtgtgcgtatgcactcgggctttccgggcgaaactgcaggtttgttgagaaattggcgcaggtggcggcctatcgaacaggcgacgatgtctttcggttacggcctgcaattgagcctgctgcaattggcgcgcgcctataccgcactgacgcacgacggcgttttactgccggtcagctttgaaaaacaggcggttgcgccgcaaggcaaacgcatattcaaagaatcgaccgcgcgcgaggtacgcaatctgatggtttccgtaaccgagccgggcggcaccggtacggcgggtgcggtggacggtttcgatgtcggcgcgaaaaccggcacggcgcgcaagttcgtcaacgggcgttatgccgacaacaaacacatcgctacctttatcggttttgcccccgccaaaaatccccgtgtgattgtggcggtaaccattgacgaaccgactgcccacggttattacggcggcgtagtggcagggccgcccttcaaaaaaattatgggcggcagcctgaacatcttgggcatttccccgaccaagccactgaccgccgcagccgtcaaaacaccgtcttaa

SEQ ID NO: 2690 - protein, 581 aa, Neisseria meningitidis
MLIKSEYKPRMLPKEEQVKKPMTSNGRISFVLMAIAVLFAGLIARGLYLQTVTYNFLKEQGDNRIVRTQTLPATRGTVSDRNGAVLALSAPTESLFAVPKEMKEMPSAAQLERLSELVDVPVDVLRNKLEQKGKSFIWIKRQLDPKVAEEVKALGLENFVFEKELKRHYPMGNLFAHVIGFTDIDGKGQEGLELSLEDSLHGEDGAEVVLRDRQGNIVDSLDSPRNKAPKNGKDIILSLDQRIQTLAYEELNKAVEYHQAKAGTVVVLDARTGEILALANTPAYDPNRPGRADSEQRRNRAVTDMIEPGSAIKPFVIAKALDAGKTDLNERLNTQPYKIGPSPVRDTHVYPSLDVRGIMQKSSNVGTSKLSARFGAEEMYDFYHELGIGVRMHSGFPGETAGLLRNWRRWRPIEQATMSFGYGLQLSLLQLARAYTALTHDGVLLPVSFEKQAVAPQGKRIFKESTAREVRNLMVSVTEPGGTGTAGAVDGFDVGAKTGTARKFVNGRYADNKHIATFIGFAPAKNPRVIVAVTIDEPTAHGYYGGVVAGPPFKKIMGGSLNILGISPTKPLTAAAVKTPS

SEQ ID NO: 2691 - DNA, 1746 bp, Neisseria meningitidis; identical to SEQ ID NO: 2689

SEQ ID NO: 2692 - protein, 581 aa, Neisseria meningitidis; identical to SEQ ID NO: 2690

SEQ ID NO: 2693 - DNA, 1548 bp, Neisseria gonorrhoeae
gtgcgtttcaatcatttcataatggtaacgattattatatatgtgatttcccctgcaaacaagccggtccgccgccccggcgttcccacttatccggctttgccttataattgctttttttatgtaacagattcacctatgaatttccccaaaacagcggcctccctgctgctgcttctcgcctccctcgccgcacacgcgctcgataccggccgcattccgcaaaacgaaatcgctgtatatgtccaagagcttgacagcggaaaagtcatcattgaccaccgtgccggcatacccgtcaatcccgcgtccacgatgaagctcgttaccgcgtttgccgccttcaaaaccttcggcagcaattaccgctgggcgaccgagtttaaaagcaacggtacggtaaacgacggcacgcttgacggaaacctgtattgggcgggcagcggcgaccccgttttcaatcaggaaaacctgcttgccgtccaacgccagttgcgcgacaaaggcatccgcaatatcacggggcgcctgatgctcgaccacagcctgtggggcgaagtcggcagtcccgaccattttgaagccgacagcggttcgccgtttatgacgcccccaaatccgactatgctgtctgccggtatggttatggtgcgcgccgaacgcaatgccgccggcagtaccgacatcctcaccgatccgcctttgccgcatatttttgcccaaaacaacttgaaaattaccgcctcccaagctgcctgcccttcggtcaaaaaactgatgcgcgcatctttttcgggcaatacgctgaaattgcgcggcaatattcccgaaagctgtttgggcaagcctgtcggtgtccggatgttcgcgcttgacgaactgatccgccaaagttttaccaaccgctggctgctcggcggcggacggatttcagacggcatcggcatagccgacacaccggaaggcgcgcagacgcttgccgttgcacactccaaaccgatgaaggaaattttgacggacatgaacaagcgttcggacaatctgattgcgcgttccgtcttcctcaaactcggcggcgacggcaaactgcccgccgtttccgaacaggcggcgtctgccgtccggcgagaacttgccgtatcgggcatcgatgttgcggatttggttttggaaaacggttcgggtctgtccagaaaagaaagggtaacggcgagaatgatggcgcaaatgttggaaacggcttatttcagcccgtttgcacaagatttcatcgacacgctgcccatcgccggcacagacgggactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgcccgacttggacaacttcgttgccaaaaacatcatctccggcggcgacggctggctggatgcgaaactgatgtgcaaagaacgccgcgcctga

SEQ ID NO: 2694 - protein, 515 aa, Neisseria gonorrhoeae
VRFNHFIMVTIIIYVISPANKPVRRPGVPTYPALPYNCFFYVTDSPMNFPKTAASLLLLLASLAAHALDTGRIPQNEIAVYVQELDSGKVIIDHRAGIPVNPASTMKLVTAFAAFKTFGSNYRWATEFKSNGTVNDGTLDGNLYWAGSGDPVFNQENLLAVQRQLRDKGIRNITGRLMLDHSLWGEVGSPDHFEADSGSPFMTPPNPTMLSAGMVMVRAERNAAGSTDILTDPPLPHIFAQNNLKITASQAACPSVKKLMRASFSGNTLKLRGNIPESCLGKPVGVRMFALDELIRQSFTNRWLLGGGRISDGIGIADTPEGAQTLAVAHSKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVAKNIISGGDGWLDAKLMCKERRA

SEQ ID NO: 2695 - DNA, 1548 bp, Neisseria meningitidis
gtgcgtctcaatcatttcataatgatagcgattattatatatgtgatttcccctgcaaacaagccggcccgccgccacagcgttcccacttatccggctttgccttataattgctttttttatgtaacagatttacctatgaatttccccaaaacagcggcctccctgctgctgcttctcgcctccctcgccgcacacgcgctcgataccggccgcattccgcaaaacgaaatcgccgtatatgtccaagagcttgacagcggaaaagtcatcattgaccaccgctcggatgtccccgtcaaccccgcctccacaatgaaactcgttaccgcgtttgccgccttcaaaaccttcggcagcaattaccgctgggcgaccgagtttaaaagcaacggtacggtaaacgacggcacgcttgacggaaacctatattgggcgggcagcggcgaccccgttttcaatcaggaaaacctgcttgatgctcaaaaacagttgcgcgaacaaggcatactcaatatcacgggacacctgatgctcgaccacagcctgtggggcgaagtcggcagccccgacgatttcgaagccgacagcggttcgccgtttatgacgccccccaatccaactatgctgtctgccggtatggttatggtgcgcgccgaacgcaatgccgccggcagtaccgacatcctcaccgatccgcctttgccgcatattttcgcccaaaacaacttgaaaattaccgcctcccaagctgcctgcccttcgatcaaaaaactgatgcgtgcatctttttcggacaatacgctgaaattgcgcggcaatattcccgagagctgtttgggcaagcctgtcggtgtccggatgttcgcgcttgacgaactgatccggcaaagttttaccaaccactggctgctcggcggcggacggatttcagacggtatcggcatagccgacacgccggaaggcgcgcagacacttgccgttgcacacgccaaaccgatgaaagaaattttgacggacatgaacaagcgttcggacaatctaattgcgcgttccgtcttcctcaaactcggcggcgacggcaaactgcccgccgtttccgaacaggcggcgtctgccgtccggcgcgaacttgccgtatcgggcatcgatgttgcggatttggttttggaaaacggttcgggcctgtccagaaaagaaagggtaacggcgagaatgatggcgcaaatgttggaaacggcttatttcagcccgtttgcacaagatttcatcgacacgctacccatcgccggcacagacggaactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgccagacttggacaacttcgttgccaacaacatcatctccggcggcgatggctggctggatgcgaaactgatgtgcaaagaacgccgagcctga

SEQ ID NO: 2696 - protein, 515 aa, Neisseria meningitidis
VRLNHFIMIAIIIYVISPANKPARRHSVPTYPALPYNCFFYVTDLPMNFPKTAASLLLLLASLAAHALDTGRIPQNEIAVYVQELDSGKVIIDHRSDVPVNPASTMKLVTAFAAFKTFGSNYRWATEFKSNGTVNDGTLDGNLYWAGSGDPVFNQENLLDAQKQLREQGILNITGHLMLDHSLWGEVGSPDDFEADSGSPFMTPPNPTMLSAGMVMVRAERNAAGSTDILTDPPLPHIFAQNNLKITASQAACPSIKKLMRASFSDNTLKLRGNIPESCLGKPVGVRMFALDELIRQSFTNHWLLGGGRISDGIGIADTPEGAQTLAVAHAKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVANNIISGGDGWLDAKLMCKERRA

SEQ ID NO: 2697 - DNA, 1548 bp, Neisseria meningitidis
gtgcgtctcaatcatttcataatgatagcgattattatatatgtgatttcccctgcaaacaagccggcccgccgccacagcgttcccacttatccggctttgccttataattgctttttttatgtaacagatttacctatgaatttccccaaaacagcggcctccctgctgctgcttctcgcctccctcgccgcacacgcgctcgatacaggtcgcattccgcaaaacgaaatcgccgtatatgtccaagagcttgacagcggaaaagtcatcattgaccaccgctcggatgtccccgtcaaccccgcctccacaatgaaactcgttaccgcgtttgccgccttcaaaaccttcggcagcaattaccgctgggcgaccgagtttaaaagcaacggtacggtaaacgacggcacgcttgacggaaacctgtattgggcgggcagcggcgaccccgttttcaatcaggaaaacctgcttgccgtccaacgccagttgcgcgaacaaggcatacgcaatatcacgggacacctgatgctcgaccacagcctgtggggcgaagtcggcagccccgacgatttcgaagccgacagcggttcgccgtttatgacgccccccaatccaactatgctgtctgccggtatggttatggtgcgcgccgaacgcaatgccgccgacagtaccgacatcctcaccgatccgcctttgccgcatattttcgcccaaaacaacttgaaaattaccgcctcccaagctgcctgcccttcgatcaaaaaactgatgcgtgcatctttttcggacaatacgctgaaattgcgcggcaatattcccgagagctgtttgggcaagcctgtcggtgtccggatgttcgcgcttgacgaactgatccggcaaagttttaccaaccactggctgctcggcggcggacggatttcagacggcatcggcatatccgacacgccggaaggcgcgcagacgcttgccgttgcacactcaaagccgatgaaggaaattttgacggacatgaacaagcgttcggacaatctaattgcgcgttccgtcttcctcaaactcggcggcgacggcaaactgcccgccgtttccgaacaggcagcgtctgccgtccggcgtgaacttgccgtgtcgggcatcgatgttgcggatttggttttggaaaacggttcaggtctgtccagaaaagaaagggtaacggcgagaatgatggcgcaaatgttggaaacggcttatttcagcccgtttgcacaagatttcatcgatacgctgcccatcgccggcacagacgggactttacgcaaccgcttcaaacaaagcggcgggctgttgcgcttaaaaaccggcacgctcaacaatgtccgcgcccttgcaggttattggctgggcgacaaaccgatggcggtggtcgtcatcatcaacagcggccgcgccgtttccctgctgcccgacttggacaacttcgttgccaacaacatcatctccggcggcgatggctggctggatgcgaaactgatgtgcaaagaacgccgagcctga

SEQ ID NO: 2698 - protein, 515 aa, Neisseria meningitidis
VRLNHFIMIAIIIYVISPANKPARRHSVPTYPALPYNCFFYVTDLPMNFPKTAASLLLLLASLAAHALDTGRIPQNEIAVYVQELDSGKVIIDHRSDVPVNPASTMKLVTAFAAFKTFGSNYRWATEFKSNGTVNDGTLDGNLYWAGSGDPVFNQENLLAVQRQLREQGIRNITGHLMLDHSLWGEVGSPDDFEADSGSPFMTPPNPTMLSAGMVMVRAERNAADSTDILTDPPLPHIFAQNNLKITASQAACPSIKKLMRASFSDNTLKLRGNIPESCLGKPVGVRMFALDELIRQSFTNHWLLGGGRISDGIGISDTPEGAQTLAVAHSKPMKEILTDMNKRSDNLIARSVFLKLGGDGKLPAVSEQAASAVRRELAVSGIDVADLVLENGSGLSRKERVTARMMAQMLETAYFSPFAQDFIDTLPIAGTDGTLRNRFKQSGGLLRLKTGTLNNVRALAGYWLGDKPMAVVVIINSGRAVSLLPDLDNFVANNIISGGDGWLDAKLMCKERRA

SEQ ID NO: 2699 - DNA, 1172 bp, Neisseria gonorrhoeae
atgccgtctgaaatgccgtctgaaacgtggcaggcggaggttcggacggcattgggtttatttcaacgggcggatgccgaccgcatcgcgtactttatccaacaattcgcgcgcttctttgcgcgctttttgcgcgcctgcctgcaaaatctcttcgatttgcgaaggattagaggtcaatgcgttgtagcgttcgcgcagttctgccaattcggcgttgattttcgccgccgaaagttttttcgcctcgccccaagccaagccgtcggcaagcatttgcgtaaattccgccgtttcagacggcgtggagaaggctttatagatttcaaacaaagggctttcgtcgggctgtttcggctcgcccggctctttcatgttggtaatgattttgttgaccgatttttgggtttttttgtcgttttcccaaagcggaatggtattgccgtaggatttggacattttgcgtccgtccaaaccgaccaagagttcgacgttttcgtcgattttcacttcgggcagggtgaagagttcttggaaaccgtgggtgaagcggccggcaatgtcgcgcgccatttcgacgtgttggatttggtcgcgcccgacggggacttcgttggcgttgaacatcaaaatgtcggcagtcatcagaatcggataactgaacaaacccatttccacaccgaaatcggggtcttcctgcccgttttccgcattggcttgaacggcggctttgtaggcgtgggcgcggttcatcaaacccttggcggtgatgcaggtcagaatccagttcaactccatcacttcgggaatgtcgctttggcggtagaaggtggtgcgctcggggtcgagtccgcaggcaagccaagtggcggcaacggcttgggtggattggtgaatcatctcctgctcgtggcatttgatgatgccgtggtaatcggcgaggaagaggaaggattcggtatcggggttttgcgccgcgcggacggcggggcggatggcgccgacgtagttgcccagatgcggggtgccggtggtggttacgccggtcagaactcgttttttgctcataaaaatgtccttacggcagcaatgccgtctgaaagggaaaagatgcgccgattatacccgatttgccacatacatccagccgacaacagacttttccatattaa

SEQ ID NO: 2700 - protein, 390 aa, Neisseria gonorrhoeae
MPSEMPSETWQAEVRTALGLFQRADADRIAYFIQQFARFFARFLRACLQNLFDLRRIRGQCVVAFAQFCQFGVDFRRRKFFRLAPSQAVGKHLRKFRRFRRRGEGFIDFKQRAFVGLFRLARLFHVGNDFVDRFLGFFVVFPKRNGIAVGFGHFASVQTDQEFDVFVDFHFGQGEEFLETVGEAAGNVARHFDVLDLVAPDGDFVGVEHQNVGSHQNRITEQTHFHTEIGVFLPVFRIGLNGGFVGVGAVHQTLGGDAGQNPVQLHHFGNVALAVEGGALGVESAGKPSGGNGLGGLVNHLLLVAFDDAVVIGEEEEGFGIGVLRRADGGADGADVVAQMRGAGGGYAGQNSFFAHKNVLTAAMPSEREKDAPIIPDLPHTSSRQQTFPY

SEQ ID NO: 2701 - DNA, 1160 bp, Neisseria meningitidis
atgccgtctgaaacgcggcaggcggaggttcggacggcatcgggttcatttcaacgggcggatgccgaccgcatcggtactttgtccaataattcgcgtgcttctttacgcgctttcgccgcgcctgcctgcaaaatctcttcgatttgcgaagggtcggcggtcagctcgttgtagcgttcgcgcggttcggcgagttcggcgttgattttcgccgccaaaagttttttggcttcaccccacgccaagccgtcggcaagcattttcgtaaattccaccgtttcagacggcgtggagaaggctttgtagatttcaaacaatgggctttcgtcgggctgtttcggctcgcccggctctttcatattggtgatgattttgttgaccgatttttgggtttttttgtcgttttcccaaagcggaatggtgttgccgtaggatttggacattttgcgtccgtccaaaccgaccaagagttcgacgttttcatcgattttcacttcgggcagggtgaagagttcccggaagcggtggttgaagcggccggcgatgtcgcgcgccatttcgacgtgttggatttggtcgcgcccgacgggcacttcgttggcgttgaacatcagaatatcggcagtcatcagaatcggataactgaacaaacccatttccacaccgaaatcagggtcttcctgcccgttttctgcatttgcctgcacggcggctttgtaggcatgggcgcggttcatcaaacccttggcagtgatgcaggtcagaatccagttcaattccatcacttcgggagtgtcgctttggcggtagaaggtggtgcgctcggggtcgagtccgcaggcaagccaagtggcggcaacggcttgggtggattggtgaatcatctccggctcgtggcatttgatgataccgtggtaatcggcgaggaagaggaaggattcggtatcgaggttttgcgccgcgcggacggcggggcggatggcgccgacgtagttgcccagatgcgggatgccggtggtggttacgccggtcagaactcgttttttgctcataaaaatgtccttgcggcatcaatgccgtctgaaagggaaaaagatgtgccgattatacccgatttgccacctacatccagccgacaacagacttttccatattaa

SEQ ID NO: 2702 - protein, 385 aa, Neisseria meningitidis
  misc_feature (26)..(26): Xaa can be any naturally occurring amino acid
MPSETRQAEVRTASGSFQRADADRIXYFVQFACFFTRFRRACLQNLFDLRRVGGQLVVAFARFGEFGVDFRRQKFFGFTPRQAVGKHFRKFHRFRRRGEGFVDFKQWAFVGLFRLARLFHIGDDFVDRFLGFFVVFPKRNGVAVGFGHFASVQTDQEFDVFIDFHFGQGEEFPEAVVEAAGDVARHFDVLDLVAPDGHFVGVEHQNIGSHQNRITEQTHFHTEIRVFLPVFCICLHGGFVGMGAVHQTLGSDAGQNPVQFHHFGSVALAVEGGALGVESAGKPSGGNGLGGLVNHLRLVAFDDTVVIGEEEEGFGIEVLRRADGGADGADVVAQMRDAGGGYAGQNSFFAHKNVLAASMPSEREKDVPIIPDLPPTSSRQQTFPY

SEQ ID NO: 2703 - DNA, 1137 bp, Neisseria meningitidis
gaggttcggacggcattgggtttatttcaacgggcggataccgaccgcatcacgtactttgcccaataattcgcgtgcttctttacgcgctttttgcgcgcctgcctgcaaaatctcttcgatttgcgaagggtcggcggtcagctcgttgtagcgttcgcgcggttcggcgagttcggcgttgattttcgccgccaaaagtttttttgcctcgccccaagccaagccgtcggcaagcattttcgtaaattctgccgtttcagacggcgtggagaaagctttgtagatttcaaacagagggctttcgtcgggcttcttcggctcgcccggctctttcatattggtgatgattttgttgaccgatttttgggtttttttgtcgttttcccaaagcggaatggtgttgccgtaggatttggacattttgcgtccgtccaaaccaaccaagagttcgacgttttcgtcgattttcacttcgggcagtgtgaagagttcccggaagcggtggttgaagcggccggcaatatcgcgtgccatttcaacgtgttggatttggtcgcgaccgactggaacttcatgggcattgaacatgagaatgtcggcagtcatgaggatagggtagctgtacaaacccatttccacgccgaaatcggggtcttcctgcccgttttccgcatttgcctgcacggcggctttgtaggcgtgggcgcggttcatcaaacccttggcggtgatgcaggtcagaatccagttcaattccatcacttcgggaatgtcgctttgacggtagaaggtggtgcgctcggggtcgagtccgcaggcaagccaagtggcggcaacggcttgggtggattggtgaatcatctccggctcgtggcatttgatgataccgtggtaatcggcgaggaagaggaaggattcggtatcagggttttgcgccgcgcggacggcggggcggatagcaccgacgtagttgcccagatgcgggatgccggtggtggttacgccggtcagaactcgttttttgctcataaaaatgtccttgcggcatcaatgccgtctgaaagggaaaaagatgcgccgattatacccgatttgccacctacatccagccgacaacagacttttccatattaa

SEQ ID NO: 2704 - protein, 377 aa, Neisseria meningitidis
EVRTALGLFQRADTDRITYFAQFACFFTRFLRACLQNLFDLRRVGGQLVVAFARFGEFGVDFRRQKFFCLAPSQAVGKHFRKFCRFRRRGESFVDFKQRAFVGLLRLARLFHIGDDFVDRFLGFFVVFPKRNGVAVGFGHFASVQTNQEFDVFVDFHFGQCEEFPEAVVEAAGNIACHFNVLDLVATDWNFMGIEHENVGSHEDRVAVQTHFHAEIGVFLPVFRICLHGGFVGVGAVHQTLGGDAGQNPVQFHHFGNVALTVEGGALGVESAGKPSGGNGLGGLVNHLRLVAFDDTVVIGEEEEGFGIRVLRRADGGADSTDVVAQMRDAGGGYAGQNSFFAHKNVLAASMPSEREKDAPIIPDLPPTSSRQQTFPY

SEQ ID NO: 2705 - DNA, 810 bp, Neisseria meningitidis
  misc_feature (709)..(709): n is a, c, g, or t
atgcccgatttttcgatgtccaatttggccgttgccttttccatcacattggctgccggtttgtttaccgtattakgyagtggcttggtgatgttttccaaaacgcccaatccgcgtgtgttgtcgtttggtttggcgtttgccggcggtgcgatggtatatgtttccctgacggagattttcagtaagtccagcgaggcgttcgctgaaatttatgataaagaccacgcgtttgcggcggcgaccatggcatttttggccgggatgggcggcattgcgctgattgaccgtctggtgccgaacccgcatgaaactttagacgcgcaagacccgtcgtttcaagaaagcaaacgccgccatatcgcgcgagtcggcatgatggcggcgtttgcgattactgcgcacaatttccccgaaggcttggcgacgttttttgccacattggaaaatccagcagtcgggatgcctttggccttggcgattgccatccataatattccggagggcatttccatcgccgcgccggtttattttgccacccgcagccgtaagaaaacggtgtgggcgtgtctgctatccggcttggccgagccgttgggggcggctttgggctatttggttttgcagccgtttttgtcgcctgccgtgtttggttcggtattcggcgtgatagccggtgtgatggtgtttttggcgttggacgagctgntgccggctgccaaacgctattcagacggccatgaaaccgtttacggcctgacaacgggtatggcggtgattgccgtcagcctggtattgttccatttttaa

SEQ ID NO: 2706 - protein, 269 aa, Neisseria meningitidis
  misc_feature (26)..(26): Xaa can be any naturally occurring amino acid
  misc_feature (237)..(237): Xaa can be any naturally occurring amino acid
MPDFSMSNLAVAFSITLAAGLFTVLXSGLVMFSKTPNPRVLSFGLAFAGGAMVYVSLTEIFSKSSEAFAEIYDKDHAFAAATMAFLAGMGGIALIDRLVPNPHETLDAQDPSFQESKRRHIARVGMMAAFAITAHNFPEGLATFFATLENPAVGMPLALAIAIHNIPEGISIAAPVYFATRSRKKTVWACLLSGLAEPLGAALGYLVLQPFLSPAVFGSVFGVIAGVMVFLALDELXPAAKRYSDGHETVYGLTTGMAVIAVSLVLFHF

SEQ ID NO: 2707 - DNA, 810 bp, Neisseria meningitidis
atgcccgatttttcgatgtccaatttggccgttgccttttccattacgttggctgccggtttgtttaccgtattaggcagcggcttggtgatgttttccaaaacgcccaatccgcgcgtgttgtcgtttggtttggcatttgccggcggtgcgatggtgtatgtttccctgacggagattttcagtaagtccagcgaggcgttcgctgaaatttatgataaagaccacgcgtttgcggcggcgaccatggcatttttggcagggatgggcggcattgcgctgattgaccgtctggtgccgaacccgcatgaaactttagacgcgcaagacccgtcgtttcaagaaagcaaacgccgccatatcgcgcgagtcggcatgatggcggcgtttgcgattactgcgcacaatttccccgaaggcttggcgacgttttttgccacattggaaaatccagcagtcgggatgcctttggccttggcgattgccatccataatattccggagggcatttccatcgccgcgccggtttattttgccacccgcagccgtaagaaaacggtgtgggcgtgtctgctatccggcttggccgagccgttgggggcggctttgggctatttggttttgcagccgtttttgtcgcctgccgtgtttggttcggtattcggcgtgatagccggtgtgatggtgtttttggcgttggacgagctgctgccggctgccaaacgctattcagacggccatgaaaccgtttacggcctgacaatgggcatggcggtgattgccgtcagcctggtattgttccatttttaa

SEQ ID NO: 2708 - protein, 269 aa, Neisseria meningitidis
MPDFSMSNLAVAFSITLAAGLFTVLGSGLVMFSKTPNPRVLSFGLAFAGGAMVYVSLTEIFSKSSEAFAEIYDKDHAFAAATMAFLAGMGGIALIDRLVPNPHETLDAQDPSFQESKRRHIARVGMMAAFAITAHNFPEGLATFFATLENPAVGMPLALAIAIHNIPEGISIAAPVYFATRSRKKTVWACLLSGLAEPLGAALGYLVLQPFLSPAVFGSVFGVIAGVMVFLALDELLPAAKRYSDGHETVYGLTMGMAVIAVSLVLFHF

SEQ ID NO: 2709 - DNA, 1089 bp, Neisseria gonorrhoeae
atgccgtccgaacccgaacggcggcatggcaatactgccctacccttcccgatagccgcacgcccaacggtcggtttttccggcaagcctttcaagataaccggcaagtgtgtcgtattgcgccgccgcattgtccaagcggttgatttcacgccgcgcctgttcgccgtcgggcatttcgccgatgtaccagcctatgtgtttgcgtgcgatgcgcacaccgacggtctcaccataaaacgcgtgcatggcgcggatgtggttcaaaatggcggctctgcattctgccaaactcaaggcaggcggtaaaacgccgtgttcggcataatgcttcaaatcgcggaaaaaccacggcctgccttgcgcgccgcgccctatcatgatgccgtcggcggcggtttgtttgaggacggcggcggctttttgcggcgaagtgatgtcgccgttgacccaggccgggatgttcagacggcttttggtctcggcgatgagttcgtaacgcgcctcgcctttgtacatttgcgtgcgcgcgcgcccgtgaacggcaagggcggcaatgccgcaatcttcggcgattttggcgacggcgggcaggttttgatcgtcgtcgtgccaacccaaacgggttttgagggtaacgggtacgcccgccgccttgaccaccgcctccaaaatggcggcaaccagcggctcgtcctgcatcagcgcgctaccggcttggacgttgcacactttcttggcggggcagcccatattgatgtcgatgacctgcgccccgagtccgacgttgtaacgcgccgcatccgccatctgttcggggtcgctgccggcaatctgcacggcaacgatgccgccttcatcggcaaaatcactgcggtgcagggtttttccggtattcctgagcgtcggatcgctggccagcatttcgcacaccgcccaacctgcgccaaacgcccgacagaggcggcggaagggtttgtcggcaatgcccgccatcggcgcaagtgcgatggggttgtcgataaaataaccgccgatgtgcataatgggcccgcgtttcaaaaaagtgcgccattgtacattttttaa

SEQ ID NO: 2710 - protein, 361 aa, Neisseria gonorrhoeae
MPSEPERRHGNTALPFPIAARPTVGFSGKPFKITGKCVVLRRRIVQAVDFTPRLFAVGHFADVPAYVFACDAHTDGLTIKRVHGADVVQNGGSAFCQTQGRRNAVFGIMLQIAEKPRPALRAAPYHDAVGGGLFEDGGGFLRRSDVAVDPGRDVQTAFGLGDEFVTRLAFVHLRARAPVNGKGGNAAIFGDFGDGGQVLIVVVPTQTGFEGNGYARRLDHRLQNGGNQRLVLHQRATGLDVAHFLGGAAHIDVDDLRPESDVVTRRIRHLFGVAAGNLHGNDAAFIGKITAVQGFSGIPERRIAGQHFAHRPTCAKRPTEAAEGFVGNARHRRKCDGVVDKITADVHNGPAFQKSAPLYIF

SEQ ID NO: 2711 - DNA, 1083 bp, Neisseria meningitidis
ttgcactttcaaaggataatcaagtgttcagaaggcatttgggcggtaggcgcacgcccaactgtcggttttttcggcaagtctttcaagataacctgcaagcatgtcgtattgcgccgccgcactgtccaagcggttgatttcacgacgtgtctgttcgccgtcgggcatttcgtcgatgtaccagcctatgtgtttgcgtgcgatgcgcacaccggcggtgtcgccgtaaaacgcgtgtatggcgcggatgtggttcaaaatagcggcggcgcattctgccaaactcaaggcaggcggcaaaacaccgtgttcggcataatgtttcaaatcgcggaagaaccacggcctgccttgcgcgccgcgccctatcataatgccgtcggcggcggtttgtttgaggacggcttgggctttttgcggcgaagtaatgtcgccgttgacccagaccgggatgttcagacggcatttggtttcggcgatgagttcgtaacgcgcttcgcctttgtacatttgcgtacgcgtgcgtccgtggacggcaagggcggcgatgccgcaatcttcggcgattttggcgatgacgggcaggttttgatggtcgtcgtgccaacccaaacgggttttgagggtaacgggtacgcctgccgcacggacgacggcttccaaaatggcggcaaccagcggctcgttctgcatcagcgcgctaccggcttggacattgcagacttttttagcgggacagcccatgttgatgtcgataagctgcgccccaaggctgacgttgtaacgcgcggcatccgccatctgctgcggatcgcttccggcaatctgcacggcaacaatgccgccttcatcggcaaaatcgctgcggtgcaaggtttttctagtatttctgagcgtcgggtcgctggtcagcatttcgcacaccgcccaacctgcgccaaaatctcggcaaagtcggcggaacggtttgtcggtaatgcccgccatcggcgcaagtgcgatggggttgtcgataaaatagccgccgatgtgcataatggatccgcgtttcaaaaaagtacgccattgtacattttttaa

SEQ ID NO: 2712 - protein, 360 aa, Neisseria meningitidis
LHFQRIIKCSEGIWAVGARPTVGFFGKSFKITCKHVVLRRRTVQAVDFTTCLFAVGHFVDVPAYVFACDAHTGGVAVKRVYGADVVQNSGGAFCQTQGRRQNTVFGIMFQIAEEPRPALRAAPYHNAVGGGLFEDGLGFLRRSNVAVDPDRDVQTAFGFGDEFVTRFAFVHLRTRASVDGKGGDAAIFGDFGDDGQVLMVVVPTQTGFEGNGYACRTDDGFQNGGNQRLVLHQRATGLDIADFFSGTAHVDVDKLRPKADVVTRGIRHLLRIASGNLHGNNAAFIGKIAAVQGFSSISERRVAGQHFAHRPTCAKISAKSAERFVGNARHRRKCDGVVDKIAADVHNGSAFQKSTPLYIF

SEQ ID NO: 2713 - DNA, 1083 bp, Neisseria meningitidis
ttgcactttcaaaggataatcaagtgttcagaaggcatttgggcggtaggcgcacgcccaactgtcggttttttcggcaagtctttcaagataacctgcaaacatgtcgtattgcgccgccgcactgtccaagcggttgatttcacgacgtgtctgttcgccgtcgggcatttcgtcgatgtaccagcctatgtgtttgcgtgcgatgcgcacaccggcggtgtcgccgtaaaacgcgtgcatggctcggatgtggttcaaaatagtggcggtacattctgccaaactcaaggcaggcggtaaaacaccgtgttcggcgtaatgtttcaaatcgcggaagaaccacggtctgccttgcgcgccgcgccctatcataatgccgtctgcggcggtttgtttgaggacggcttgggctttttgcggcgaggtaatgtcgccgttgacccagaccgggatgttcagacggcatttggtttcggcaatcaggtcgtaagccgcttcgcctttgtacatttgcgtgcgcgtgcgtccgtggacggcaagggcggcaatgccgcaatcttcggcgattttggcgatgacgggcaggttttgatggtcgtcgtgccaacccaaacgggttttgagggtaacgggtacgcccgccgctttgaccaccgcctccaaaatggcggcaaccagcggctcgttctgcatcagcgcgctaccggcttggacattgcagacttttttagcgggacagcccatgttgatgtcgataagctgcgccccaaggctgacgttgtaacgcgcggcatccgccatctgctgcggatcgcttccggcaatctgcacggcaacaatgccgccttcatcggcaaaatcgctgcggtgcaaggtttttctagtatttctgagcgtcgggtcgctggtcagcatttcgcacaccgcccaacctgcgccaaaatctcggcaaagtcggcggaacggtttgtcggtaatgcccgccatcggcgcaagtgcgatggggttgtcgataaaatagccgccgatgtgcataatggatccgcgtttcaaaaaagtacgccattgtacattttttaa

SEQ ID NO: 2714 - protein, 359 aa, Neisseria meningitidis
LHFQRIIKCSEGIWAVGARPTVGFFGKSFKITCKHVVLRRRTVQAVDFTTCLFAVGHFVDVPAYVFACDAHTGGVAVKRVHGSDVVQNSGGTFCQTQGRRNTVFGVMFQIAEEPRSALRAAPYHNAVCGGLFEDGLGFLRRGNVAVDPDRDVQTAFGFGNQVVSRFAFVHLRARASVDGKGGNAAIFGDFGDDGQVLMVVVPTQTGFEGNGYARRFDHRLQNGGNQRLVLHQRATGLDIADFFSGTAHVDVDKLRPKADVVTRGIRHLLRIASGNLHGNNAAFIGKIAAVQGFSSISERRVAGQHFAHRPTCAKISAKSAERFVGNARHRRKCDGVVDKIAADVHNGSAFQKSTPLYIF

SEQ ID NO: 2715 - DNA, 1578 bp, Neisseria gonorrhoeae
atggcaacacaggtaggcggtgcaaattcggatgaggcaagcccctgctttcctatttctgaggtggaattggtgggtgaagaaacggctaaattccggtttgcgctcaaccatgccttgtgccaaacacattttgtttccggcaagtgtctgcatgcgggcgacattaatcaaatcatgtccttagcacaaaatgctttgatcggcaggggatataccacgacccgtatcttggctgcgccacaggatttgaatagtggcaagcttcaattaaccctgatgccgggctatctgcgctccatacgaatcgatcggtccaacgatgatcaaacccatgcaggacgtattgcagcattccaaaacaaatttcccacccgctcgaacgatctgttgaatctgcgtgatttggaacaaggactggaaaatctcaaatgtctcccgactgcggaagccgatctccaaatcgttcccgtagagagagaaccaaaccaaagtgatgtcgtggtgcaatggcggtaacgtctgctgccctactgtgtgagtgtggggatggataattcgggtagtgaggcgacaggaaaataccaaggaaatatcactttctctgccgacaatccttttggactgagtgatatgttctatgtaaattatggacgttcaattggcggtacgcccgatgaggaaaattttgacggccatcgcaaagaaggcggatcaaacaattacgccgtacattattcagcccctttcggtaaatggacatgggcattcaatcacaatggctaccgttaccatcaggcggtttccggattatcggaagtctatgactataatggaaaaagttacaacactgatttcggcttcaaccgcctgttgtatcgtgatgccaaacgcaaaacctatctcagtgtaaaactgtggacgagggaaacaaaaagttacattgatgatgccgaactgactgtacaacggcgtaaaaccacaggttggttggcagaactttcccacaaaggatatatcggtcgcagtacggcagattttaagttgaaatataaacacggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgcctgccgagcggggatggtattggcgcaacgatttgagctggcaatttaaaccaggccatcagctttatcttggggctgatgtaggacatgtttcaggacaatccgccaaatggttatcgggccaaactctagccggcacagcaattgggatacgcgggcagataaagcttggcggcaacctgcattacgatatatttaccggccgtgcattgaaaaagcccgaatattttcagacgaagaaatgggtaacggggtttcaggtgggttattcgttttga

SEQ ID NO: 2716 - protein, 525 aa, Neisseria gonorrhoeae
  misc_feature (173)..(173): Xaa can be any naturally occurring amino acid
MATQVGGANSDEASPCFPISEVELVGEETAKFRFALNHALCQTHFVSGKCLHAGDINQIMSLAQNALIGRGYTTTRILAAPQDLNSGKLQLTLMPGYLRSIRIDRSNDDQTHAGRIAAFQNKFPTRSNDLLNLRDLEQGLENLKCLPTAEADLQIVPVEREPNQSDVVVQWRXRLLPYCVSVGMDNSGSEATGKYQGNITFSADNPFGLSDMFYVNYGRSIGGTPDEENFDGHRKEGGSNNYAVHYSAPFGKWTWAFNHNGYRYHQAVSGLSEVYDYNGKSYNTDFGFNRLLYRDAKRKTYLSVKLWTRETKSYIDDAELTVQRRKTTGWLAELSHKGYIGRSTADFKLKYKHGTGMKDALRAPEEAFGEGTSRMKIWTASADVNTPFQIGKQLFAYDTSVHAQWNKTPLTSQDKLAIGGHHTVRGFDGEMSLPAERGWYWRNDLSWQFKPGHQLYLGADVGHVSGQSAKWLSGQTLAGTAIGIRGQIKLGGNLHYDIFTGRALKKPEYFQTKKWVTGFQVGYSF

SEQ ID NO: 2717 - DNA, 1644 bp, Neisseria meningitidis
atgcagcgtcagcagcacatagatgctgaattgttaactgatgcaaatgtccgtttcgagcaaccattggagaagaacaattatgtcctgagtgaagatgaaacaccgtgtactcgggtaaattacattagtttagatgataagacggtgcgcaaattttcttttcttccttctgtgctcatgaaagaaacagcttttaaaactgggatgtgtttaggttccaataatttgagcaggctacaaaaagccgcgcaacagatactgatcgtgcgtggctacctcacttcccaagctattatccaaccacagaatatggattcgggaattctgaaattacgggtatcagcaggcgaaataggggatatccgctatgaagaaaaacgggatgggaagtctgccgagggcagtattagtgcattcaataacaaatttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggcgcacaaaacggacttgactgatgccaccggtacggaaactgaaagcggatccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacagacttcataaaacttcagtcggaatgaaattatggacacgccaaacctataaatacatcgacgatgccgaaatcgaagtacaacgccgccgctctgcaggctgggaagccgaattgcgccaccgtgcttacctcaaccgttggcagcttgacggcaagttgtcttacaaacgcgggaccggcatgcgccaaagtatgcctgcaccggaagaaaacggcggcgatattcttccaggtacatctcgtatgaaaatcattactgccagtttggacgcagccgccccatttaytttaggcaaacagcagtttttctacgcaaccgccattcaagctcaatggaacaaaacgccgttggttgcccaagataaattgtcaatcggcagccgctacaccgttcgcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggcttcagaggagggcataaagtaggcggtatgtttgcttatgatctgtttgccggcaagccgcttcataaacccaaaggctttcagacgaccaacaccgtttacggcttcaacttgaattacagtttctaa

SEQ ID NO: 2718 - protein, 547 aa, Neisseria meningitidis
  misc_feature (411)..(411): Xaa can be any naturally occurring amino acid
MQRQQHIDAELLTDANVRFEQPLEKNNYVLSEDETPCTRVNYISLDDKTVRKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLAHKTDLTDATGTETESGSRSYSVHYSVPVKKWLFSFNHNGHRYHEATEGYSVNYDYNGKQYQSSLAAERMLWRNRLHKTSVGMKLWTRQTYKYIDDAEIEVQRRRSAGWEAELRHRAYLNRWQLDGKLSYKRGTGMRQSMPAPEENGGDILPGTSRMKIITASLDAAAPFXLGKQQFFYATAIQAQWNKTPLVAQDKLSIGSRYTVRGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 2719 - DNA, 1644 bp, Neisseria meningitidis
  misc_feature (1339)..(1339): n is a, c, g, or t
  misc_feature (1515)..(1515): n is a, c, g, or t
  misc_feature (1527)..(1527): n is a, c, g, or t
atgcagcgtcagcagcacatagatgctgaattgttaactgatgcaaatgtccgtttcgagcaaccattggagaagaacaattatgtcctgagtgaagatgaaacaccgtgtactcgggtaaattacattagtttagatgataagacggcgcgcaaattttcttttcttccttctgtgctcatgaaagaaacagcttttaaaactgggatgtgtttaggttccaataatttgagcaggctacaaaaagccgcgcaacagatactgattgtgcgtggctacctcacttcccaagctattatccaaccacagaatatggattcgggaattctgaaattacgggtatcagcaggcgaaataggggatatccgctatgaagaaaaacgggatgggaagtctgccgagggcagtattagtgcattcaataacaaatttcccttatataggaacaaaattctcaatcttcgcgatgtagagcagggcttggaaaacctgcgtcgtttgccgagtgttaaaacagatattcagattataccgtccgaagaagaaggcaaaagcgatttacagatcaaatggcagcagaataaacccatacggttcagtatcggtatagatgatgcgggcggcaaaacgaccggcaaatatcaaggaaatgtcgctttatcgttcgataaccctttgggcttaagcgatttgttttatgtttcatatggacgcggtttggtgcacaaaacggacttgactgatgccaccggtacggaaactgaaagcggatccagaagttacagcgtgcattattcggtgcccgtaaaaaaatggctgttttcttttaatcacaatggacatcgttaccacgaagcaaccgaaggctattccgtcaattacgattacaacggcaaacaatatcagagcagcctggccgccgagcgcatgctttggcgtaacaggtttcataaaacttcagtcggaatgaaattatggacacgccaaacctataaatacatcgacgatgccgaaatcgaagtgcaacgccgccgctctgcaggctgggaagccgaattgcgccaccgtgcttacctcaaccgttggcagcttgacggcaagttgtcttacaaacgcgggaccggcatgcgccaaagtatgcccgcacctgaagaaaacggcggcggtactattccaggcacatcccgtatgaaaatcataaccgccggattggatgcagcggccccgtttatgttgggcaaacagcagtttttctacgcaaccgccattcaagctcaatggaacaaaacgcctttggttgcccaagacaagttgtctatcggcagccgctacaccgttngcggatttgatggggagcagagtcttttcggagagcgaggtttctactggcagaatactttaacttggtattttcatccgaaccatcagttctatctcggtgcggactatggccgcgtatctggcgaaagtgcacaatatgtatcgggcaagcagctgatgggtgcagtggtcggnttcagaggaggncataaagtaggcggtatgtttgcttatgatctgtttgccggcaagccgcttcataaacccaaaggctttcagacgaccaacaccgtttacggcttcaacttgaattacagtttctaa

SEQ ID NO: 2720 - protein, 547 aa, Neisseria meningitidis
  misc_feature (447)..(447): Xaa can be any naturally occurring amino acid
MQRQQHIDAELLTDANVRFEQPLEKNNYVLSEDETPCTRVNYISLDDKTARKFSFLPSVLMKETAFKTGMCLGSNNLSRLQKAAQQILIVRGYLTSQAIIQPQNMDSGILKLRVSAGEIGDIRYEEKRDGKSAEGSISAFNNKFPLYRNKILNLRDVEQGLENLRRLPSVKTDIQIIPSEEEGKSDLQIKWQQNKPIRFSIGIDDAGGKTTGKYQGNVALSFDNPLGLSDLFYVSYGRGLVHKTDLTDATGTETESGSRSYSVHYSVPVKKWLFSFNHNGHRYHEATEGYSVNYDYNGKQYQSSLAAERMLWRNRFHKTSVGMKLWTRQTYKYIDDAEIEVQRRRSAGWEAELRHRAYLNRWQLDGKLSYKRGTGMRQSMPAPEENGGGTIPGTSRMKIITAGLDAAAPFMLGKQQFFYATAIQAQWNKTPLVAQDKLSIGSRYTVXGFDGEQSLFGERGFYWQNTLTWYFHPNHQFYLGADYGRVSGESAQYVSGKQLMGAVVGFRGGHKVGGMFAYDLFAGKPLHKPKGFQTTNTVYGFNLNYSF

SEQ ID NO: 2721 - DNA, 1311 bp, Neisseria gonorrhoeae
atgatgcagcacaatcgtttcttcgcggtcggggccggtggagacgatggcgaccggcgcgccgcagacttcttcaatccgtttcaaatatgctttggcattggcaggcaatgcgtcgtagcttttcacgccgacagtcgattcgcgccagccgggcatggtttcgtaaatcggtttgcaggtttccaccgcatccgaaccgcaaggcaggatgtcggttttgccgccgcctggcaattcgtagccgacgcagatattgatggtttcaacgccgtccattacatcgagtttggtaatgcacataccggaaatgccgttgatttggatggagcgtttcagggcggcggcatcaaaccagccgcagcggcgcgcgcggccggttaccgaaccgaattcgtgtccgcgctccgccaaacctgcgcctacttcgtcgaacaattcggtcgggaacgggcccgaaccgacgcgcgtggtataggctttgacgatgcccaaaacataatccagcatttgaggacctacgcccgcgcctgccgaagccgcgccggcgagacagttggacgaggtaacgaaggggtaagtgccgtagtcgatgtccaacaacgcaccttgcgcgccttcaaacagcagtttttcgccgtttttgtttttttcgttcaacacgcgggacacgtcggcaatcatcggcgcaatgcgcggcgcgactttttcgataaccgccatcacgtcttccgctttaaccggtccggcgttatgcaggtattggagttggacgttgtaataggcaaggacggcatccagtttttcacgcagtttttcaggatgcagcaaatcggcggcgcgaatggcgcggcgtgccactttgtcttcgtaggcagggccgatgccgcggccggtcgtgccgattttgcctttgccgcgcgatgcttcgcgggcttggtcgagcgcgatgtggtaaggcaggatcagcgggcaggtcggcgcgattttcagacggccttcgacgtttttcacgcctgccgcgttcaactcgtcgatttcgcccaacagggcttcgggggaaacgacaacgcccgaaccgatgaagcaatccaatccttcgtgcaggataccgctcggaatcaggcgcaaaatggtttttttgccgccgacgaccaaggtatggcccgcattgtggccgccttggaagcgcacgacgctgccggcttcttccgccagccagtcaacgattttacctttaccctcgtcgccccactgtgcgccgattactacaacatttttagccatagccatataacctatcgatattaa

SEQ ID NO: 2722 - protein, 436 aa, Neisseria gonorrhoeae
MMQHNRFFAVGAGGDDGDRRAADFFNPFQICFGIGRQCVVAFHADSRFAPAGHGFVNRFAGFHRIRTARQDVGFAAAWQFVADADIDGFNAVHYIEFGNAHTGNAVDLDGAFQGGGIKPAAAARAAGYRTEFVSALRQTCAYFVEQFGRERARTDARGIGFDDAQNIIQHLRTYARACRSRAGETVGRGNEGVSAVVDVQQRTLRAFKQQFFAVFVFFVQHAGHVGNHRRNARRDFFDNRHHVFRFNRSGVMQVLELDVVIGKDGIQFFTQFFRMQQIGGANGAACHFVFVGRADAAAGRADFAFAARCFAGLVERDVVRQDQRAGRRDFQTAFDVFHACRVQLVDFAQQGFGGNDNARTDEAIQSFVQDTARNQAQNGFFAADDQGMARIVAALEAHDAAGFFRQPVNDFTFTLVAPLCADYYNIFSHSHITYRY

SEQ ID NO: 2723 - DNA, 1310 bp, Neisseria meningitidis
atgatgcagcacaatcgtttcttctcggtcggggccggtggagacgatggcgaccggcgcgccgcagacttcttcaatccgtttcaaatatgctttggcgttttcgggcaatgcgccgtagtccttcacgccgaaagtggattcgcgccagccgggcatggtttcgtaaatcggcttgcaggtttccaccgcatcggaaccgcaaggcaggatgtcggttttgccgccgtcgggcaattcatagccgacgcagatattgatggtttcaacgccgtccattacatcgagtttagtaatacacataccggaaatgccgttgatttggatggagcgtttcagggcggcggcatcaaaccagccgcagcggcgtgcgcgtccggttaccgaaccgaattcgtgtccgcgttctgccaaacctacgcctacttcgtcgaacaattcggtcgggaacgggcccgaaccgacgcgcgtggtataggctttgacgatgcccaaaacataatccagcatttgaggacctacgcccgcgcctgccgaagctgcgcccgccagacagttggacgaggtaacgaagggataagtgccgtagtcgatgtccaacaacgcaccttgcgcgccttcaaacagcagtttttcgccgtttttgtttttctcgttcaacacgcgggacacgtcggtaatcatcggcgcaatgcgcggcgcgactttttcgataaccgccatcacgtcttccgctttaaccggctcggcattgtgcagatgttgcagttggacattgtaataggcaaggacggcatccagtttttcacgcagtttytcaggatgcagcaaatcggcggcgcgaatggcgcggcgtgccactttgtcttcgtaggcagggccgatgccgcggccggtcgtgccgattttgcctttgccgcgcgatcttcgcgggcttggtcgagcgcgatgtggtaaggcaggatcagcgggcaggtcggcgcgattttcagacggccttcgacgtttttcacgcctgccgcgttcaactcgtcgatttcgcccaacagggcttcgggggagacgacaacgcccgaaccgatgaagcagtccaaactttcatgcaggatgccgctcggaatcaggcgcaaaatggtttttttgccgccgacaaccaaggtatggcccgcattgtggccgccttggaagcgcaccacgccgccggcttcttccgccagccagtcaacgattttacctttaccctcgtcgccccactgtgcgccgattastacaacatttttagccatagccatataacctatcgatattaa

SEQ ID NO: 2724 - protein, 436 aa, Neisseria meningitidis
  misc_feature (273)..(273): Xaa can be any naturally occurring amino acid
  misc_feature (308)..(308): Xaa can be any naturally occurring amino acid
  misc_feature (423)..(423): Xaa can be any naturally occurring amino acid
MMQHNRFFSVGAGGDDGDRRAADFFNPFQICFGVFGQCAVVLHAESGFAPAGHGFVNRLAGFHRIGTARQDVGFAAVGQFIADADIDGFNAVHYIEFSNTHTGNAVDLDGAFQGGGIKPAAAACASGYRTEFVSAFCQTYAYFVEQFGRERARTDARGIGFDDAQNIIQHLRTYARACRSCARQTVGRGNEGISAVVDVQQRTLRAFKQQFFAVFVFLVQHAGHVGNHRRNARRDFFDNRHHVFRFNRLGIVQMLQLDIVIGKDGIQFFTQFXRMQQIGGANGAACHFVFVGRADAAAGRADFAFAAXIFAGLVERDVVRQDQRAGRRDFQTAFDVFHACRVQLVDFAQQGFGGDDNARTDEAVQTFMQDAARNQAQNGFFAADNQGMARIVAALEAHHAAGFFRQPVNDFTFTLVAPLCADXYNIFSHSHITYRY

SEQ ID NO: 2725 - DNA, 1310 bp, Neisseria meningitidis
atgatgcagcacaatcgtttcttcgcggtcggggccggtggagacgatggcgaccggcgcaccgcagacttcttcaatccgtttcaaatatgctttggcattggcaggtaatgcgtcgtagcttttcacgccgaaagtggattcgctccaaccgggcatggtttcgtaaatcggcttgcaggcttctaccgcatcagagccgcaaggcaggatgtcggttttgccgccgtcgggcaattcgtagccgacgcagatattgatggtttcaacgccgtccattacatcgagtttggtaatacacataccggaaatgccgttgatttggatggagcgtttcagggcggcggcatcaaaccagccgcagcggcgtgcgcgtccggttaccgaaccgaattcgtgtccgcgttctgccaaacctgctccgacttcgtcgaacaattcggtcgggaacgggcccgaaccgacgcgcgtggtataggctttgacgatgcccaaaacataatccagcatttgagggcctacgcccgcgcctgccgaagccgcgccggcgaggcagttggacgaagtaacgaaggggtaagtgccgtagtcgatgtccaacaacgcaccttgcgcgccttcaaacagcagtttttcgccgtttttgtttttttcgttcaacacgcgggacacgtcggtaatcatcggcgtaatgcgcggcgcgactttttcgataaccgccatcacgtcttccgctttcaccgactcggcattgtgcagatgttgcagttggacgttgtaataagcaaagacggcatccagtttttcacgcagtttttcaggatgcagcaaatcggcggcgcgaatggcgcggcgtgccactttgtcttcgtaggcagggccgatgccgcggccggtcgtgccgattttgcctttgccgcgcgatgcttctcgggcttggtcgagcgcgatgtgataaggcaggatcagcgggcaggtcggcgcgattttcagacggccttcgacgtttttcacgcctgccgcgttcaactcgtcgatttcgcccaacagggcttcgggggagacgacaacgcccgaaccgatgaagcagtccagactttcatgcaggatgccgctcggaatcaggcgcaaaatggtttttttgccgccgacaaccaaggtatgacccgcattgtggccgccttggaagcgcaccacgcctccggcttcttccgccagccagtcaacgattttacctttaccctcgtcgccccactgtgcgccgattactacaacatttttagccatagccatataaccttcgatattaa

SEQ ID NO: 2726 - protein, 435 aa, Neisseria meningitidis
  misc_feature (433)..(433): Xaa can be any naturally occurring amino acid
MMQHNRFFAVGAGGDDGDRRTADFFNPFQICFGIGRCVVAFHAESGFAPTGHGFVNRLAGFYRIRAARQDVGFAAVGQFVADADIDGFNAVHYIEFGNTHTGNAVDLDGAFQGGGIKPAAAACASGYRTEFVSAFCQTCSDFVEQFGRERARTDARGIGFDDAQNIIQHLRAYARACRSRAGEAVGRSNEGVSAVVDVQQRTLRAFKQQFFAVFVFFVQHAGHVGNHRRNARRDFFDNRHHVFRFHRLGIVQMLQLDVVISKDGIQFFTQFFRMQQIGGANGAACHFVFVGRADAAAGRADFAFAARCFSGLVERDVIRQDQRAGRRDFQTAFDVFHACRVQLVDFAQQGFGGDDNARTDEAVQTFMQDAARNQAQNGFFAADNQGMTRIVAALEAHHASGFFRQPVNDFTFTLVAPLCADYYNIFSHSHITXRY

SEQ ID NO: 2727 - DNA, 339 bp, Neisseria meningitidis
atgaaatatatcgtatcaatctctctggctatgggattggctgcctgttcgtttgggggatttaaaccaaatccgtgggacgccgcgtcattttgggaattgaaaaattacgccaatccctatccgggatcagcctcggcggcacttgaccaatatccatcgaaagcaagacgaaggcaactgaaagacatgcaagagtgcggctatgacccaatagacggcggaaagtctgaagcagatgcctgcctgaggaaaaaaggctggtgtcgtaagggtttcgacccttatcccgaaaacaaaaaatacgaatggcctcgagaagaaggaaaaacaaaatga

SEQ ID NO: 2728 - protein, 112 aa, Neisseria meningitidis
MKYIVSISLAMGLAACSFGGFKPNPWDAASFWELKNYANPYPGSASAALDQYPSKARRRQLKDMQECGYDPIDGGKSEADACLRKKGWCRKGFDPYPENKKYEWPREEGKTK

SEQ ID NO: 2729 - DNA, 378 bp, Neisseria gonorrhoeae
atgaaaaaaccgaccgataccctacccgtcaatctgcaacgccgccgcctgctgtgtgccgccggcgcgctgttgatcagcccgctggcgcacgccggcgcgcaacgtgaagaaacgcttgccgacgatgtggcttccgtgatgaggagttctgtcggcagcgtcaatccgccgaggctggtgttcgacaatccgaaagagggcgaacgttggttgtccgcgatgtcggcacgtttggcaagattcgtccccgacgagggggagcggcgcaggctgctggtcaatatccaatacgaaagcagccgggccggtttggatacgcagattgtgttggggctgattgaagtggaaagcgggtaccgagctcgaatcatatca

SEQ ID NO: 2730 - protein, 126 aa, Neisseria gonorrhoeae
MKKPTDTLPVNLQRRRLLCAAGALLISPLAHAGAQREETLADDVASVMRSSVGSVNPPRLVFDNPKEGERWLSAMSARLARFVPDEGERRRLLVNIQYESSRAGLDTQIVLGLIEVESGYRARIIS

SEQ ID NO: 2731 - DNA, 624 bp, Neillia sinensis
atgagaaaaccgaccgataccctacccgttaatctgcaacgccgccgcctgttgtgtgccgccggtgcgttgttgctcagtcctctggcgcacgccggcgcgcaacgtgaggaaacgcttgccgacgatgtggcttccgtgatgaggagttctgtcggcagcgtcaatccgccgaggctggtgtttgacaatccgaaagagggcgagcgttggttgtctgccatgtcggcacgtttggcaaggttcgtccccgaggaggaggagcggcgcaggctgctggtcaatatccagtacgaaagcagccgggccggtttggatacgcagattgtgttggggctgattgaggtggaaagcgcgttccgccagtatgcaatcagcggtgtcggcgcgcgcggcctgatgcaggttatgccgttktggaaaaactacatcggcaaaccggcgcacaacctgttcgacatccgcaccaacctgcgttacggctgtaccatcctgcgccattaccggaatcttgaaaaaggcaacatcgtccgcgcgcttgcccgctttaacggcagcttgggcagcaataaatatccgaacgccgttttgggcgcgtggcgcaaccgctggcagtggcgttga

SEQ ID NO: 2732 - protein, 207 aa, Neisseria meningitidis
  misc_feature (139)..(139): Xaa can be any naturally occurring amino acid
MRKPTDTLPVNLQRRRLLCAAGALLLSPLAHAGAQREETLADDVASVMRSSVGSVNPPRLVFDNPKEGERWLSAMSARLARFVPEEEERRRLLVNIQYESSRAGLDTQIVLGLIEVESAFRQYAISGVGARGLMQVMPXWKNYIGKPAHNLFDIRTNLRYGCTILRHYRNLEKGNIVRALARFNGSLGSNKYPNAVLGAWRNRWQWR

SEQ ID NO: 2733 - DNA, 624 bp, Neisseria meningitidis
atgaaaaaaccgaccgataccctacccgtcaatctgcaacgccgccgcctattgtgtgctgccggcgcgctgttgctcagcccgctggcacaagccggcgcgcaacgtgaagaaacgcttgccgacgatgtggcttccgtgatgaggagctctgtcggcagcataaatccgccgaggctggtgttcgacaatccgaaagagggcgagcgttggctgtccgcgatgtctgctcggttggcaaggttcgtccccgatgaggaggagcggcgcaggctgctggtcaatatccagtacgaaagcagccgggccggtttggatacgcagattgtgttggggctgattgaggtggaaagcgcgttccgccagtatgcaatcagcggtgtcggcgcgcgcggcctgatgcaggttatgccgttttggaaaaactacatcggcaaaccggcgcacaacctgttcgacatccgcaccaacctgcgttacggctgtaccatcctgcgccattaccggaatcttgaaaaaggcaacatcgtccgcgcactcgcccgttttaacggtagcctcggcagcaataaatatccgaacgccgttttgggcgcgtggcgcaaccgctggcagtggcgttga

SEQ ID NO: 2734 - protein, 207 aa, Neisseria meningitidis
MKKPTDTLPVNLQRRRLLCAAGALLLSPLAQAGAQREETLADDVASVMRSSVGSINPPRLVFDNPKEGERWLSAMSARLARFVPDEEERRRLLVNIQYESSRAGLDTQIVLGLIEVESAFRQYAISGVGARGLMQVMPFWKNYIGKPAHNLFDIRTNLRYGCTILRHYRNLEKGNIVRALARFNGSLGSNKYPNAVLGAWRNRWQWR

SEQ ID NO: 2735 - DNA, 500 bp, Neisseria gonorrhoeae
atgagaaaagccgtctaagccggtataaacaaaataaactcattgggctatttgtcgcaggtgtaactgcaagaacagcggcagagttggtaggcattaataaaaataccgcagcctatgattttcatcgtttacgatgactgatttatcaaaacggtccgcatttagaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagtattgtttatacggattgttatcgtagctatgatgtattagatgtgagcgaatttagccattttagcttcgctgaaacttcgttttcgtatcaatcacagcacacattttgccgaacgacaaaaccatattaa

SEQ ID NO: 2736 - protein, 165 aa, Neisseria gonorrhoeae
  misc_feature (2)..(2): Xaa can be any naturally occurring amino acid
MXKSRLSRYKQNKLIGLFVAGVTARTAAELVGINKNTAAYDFHRLRLIYQNGPHLEMFDGEVEADESYFGGQRKGKRGRGAAGKVAVFGLLKRNGKVYTVTVPNTQTATLFPIIREQVKPDSIVYTDCYRSYDVLDVSEFSHFSFAETSFSYQSQHTFCRTTKPY

SEQ ID NO: 2737 - DNA, 501 bp, Neisseria meningitidis
atgagaaaaagtcgtctaagccagtataaacaaamtaaactcattgaactgtttgtcacaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattttttatacggattgttatcgtagctatgatgtattagatgtgcgcgaatttagccattttagcttcgctgaaacttcgttttcgtatcaatcacagcacacattttgccgaacgacaaaaccatattaa

SEQ ID NO: 2738 - protein, 166 aa, Neisseria meningitidis
  misc_feature (12)..(12): Xaa can be any naturally occurring amino acid
MRKSRLSQYKQXKLIELFVTGVTARTAAELVGVNKNTAAYYFHRLRLLIYQNSPHLEMFDGEVEADESYFGGQRKGKRGRGAAGKVAVFGLLKRNGKVYTVTVPNTQTATLFPIIREQVKPDSIFYTDCYRSYDVLDVREFSHFSFAETSFSYQSQHTFCRTTKPY

SEQ ID NO: 2739 - DNA, 501 bp, Neisseria meningitidis
atgagaaaaagtcgtctaagccagtataaacaaaataaactcattgagctatttgtcgcaggtgtaactgcaagaacggcagcagagttagtaggcgttaataaaaataccgcagcctattattttcatcgtttacgattacttatttatcaaaacagtccgcatttggaaatgtttgatggcgaagtagaagcagatgaaagttattttggcggacaacgcaaaggcaaacgcggtcgcggtgctgccggtaaagtcgccgtattcggtcttttgaagcgaaatggtaaggtttatacggttacagtaccgaatactcaaaccgctactttatttcctattatccgtgaacaagtgaaacctgacagcattgtttatacggattgttatcgtagctatgatgtattagatgtgcgcgaatttagccattttagcttcgctgaaacttcgttttcgtatcaatcacagcacacattttgccgaacgacaaaaccatattaa

SEQ ID NO: 2740 - protein, 166 aa, Neisseria meningitidis
MRKSRLSQYKQNKLIELFVAGVTARTAAELVGVNKNTAAYYFHRLRLLIYQNSPHLEMFDGEVEADESYFGGQRKGKRGRGAAGKVAVFGLLKRNGKVYTVTVPNTQTATLFPIIREQVKPDSIVYTDCYRSYDVLDVREFSHFSFAETSFSYQSQHTFCRTTKPY

SEQ ID NO: 2741 - DNA, 327 bp, Neisseria gonorrhoeae
atgcgtaaaaccgtacttatcctgaccatctccgccgcccttttgtcgggctgcacatgggaaacttatcaagacggcagcggcaaaaccgccgtccgtgcaaaatgttccaccggcacgccgctgtgttggcaagacgggcgcggctcgaaaaaggtggactgcgacgagtacggtggcgaacgccgggccgtgttgcgcaaccaaaagcgggggaagcccgcgacgaggagagccgcaacgctggggaaaccgagtttccgggcgagggacgggggggggcgggtgaacagggcagaaacgggggaggggaagcgatcggcgagg

SEQ ID NO: 2742 - protein, 109 aa, Neisseria gonorrhoeae
MRKTVLILTISAALLSGCTWETYQDGSGKTAVRAKCSTGTPLCWQDGRGSKKVDCDEYGGERRAVLRNQKRGKPATRRAATLGKPSFRARDGGGRVNRAETGEGKRSAR

SEQ ID NO: 2743 - DNA, 273 bp, Neisseria meningitidis
atgcgtaaaaccttcctcttcctgaccgctgccgccgcccttttgtcgggctgcgcgtgggaaacttatcaagacggcaacggcaagaccgccgtccgtcaaaaatatcccgccggcacgcccgtttattaccaagacggcagctactcgaaaaatatgaactacaaccaataccgtcccgaacgccatgccgtgttacccaatcaaaccggcaacaacgccgacgaagagcatcgccaacactggcaaaaaccaaagtttcaaaaccgataa

SEQ ID NO: 2744 - protein, 90 aa, Neisseria meningitidis
MRKTFLFLTAAAALLSGCAWETYQDGNGKTAVRQKYPAGTPVYYQDGSYSKNMNYNQYRPERHAVLPNQTGNNADEEHRQHWQKPKFQNR

SEQ ID NO: 2745 - DNA, 273 bp, Neisseria meningitidis
atgcgtaaaaccttccttatcctgatgactgccgccgcccttttgtcgggctgcgcgtgggaaacttatcaagacggcaacggcaagaccgccgtccgtcaaaaatatcccgccggcacgcccgtttattaccaagacggcagctactcgaaaaatatgaactacaaccaataccgtcccgaacgccatgccgtgttacccaaccaaaccggcaacaacgccgacgaagagcatcgccaacactggcaaaagcccaaatttcaaaaccgataa

SEQ ID NO: 2746 - protein, 90 aa, Neisseria meningitidis
MRKTFLILMTAAALLSGCAWETYQDGNGKTAVRQKYPAGTPVYYQDGSYSKNMNYNQYRPERHAVLPNQTGNNADEEHRQHWQKPKFQNR

SEQ ID NO: 2747 - DNA, 285 bp, Neisseria gonorrhoeae
atgaaaaaactgttattggccgccgttgtttccctaaatgccgcaaccgcatttgccggcgactctgccgagcgtcagatttacggcgatccccattttgaacaaaaccgcacaaaagccgtgaaaatgttggaacagcgcggttatcaggtttacgatgtcgatgccgacgactactggggcaaacctgttttggaagtggaagcctataaagacggccgcgaatacgacatcgtgttgtcttaccccgacctgaaaatcatcaaagagcagctcgatcgctga

SEQ ID NO: 2748 - protein, 94 aa, Neisseria gonorrhoeae
MKKLLLAAVVSLNAATAFAGDSAERQIYGDPHFEQNRTKAVKMLEQRGYQVYDVDADDYWGKPVLEVEAYKDGREYDIVLSYPDLKIIKEQLDR

SEQ ID NO: 2749 - DNA, 285 bp, Neisseria meningitidis
atgaaaaaactgttattggctgccgttgtttctctgagtgccgctgccgcatttgccggcgactctgccgagcgtcagatttacggcgatccccattttgaacaaaaccgcacaaaagctgtgaaaatgttggagcagcgcggttatcaggtttacgatgtcgatgccgacgaccattggggtaagcctgtgctggaagtggaagcctataaagacggccgcgaatacgacatcgtgttgtcttaccccgacctgaaaatcatcaaagagcagctcgatcgctga

SEQ ID NO: 2750 - protein, 94 aa, Neisseria meningitidis
MKKLLLAAVVSLSAAAAFAGDSAERQIYGDPHFEQNRTKAVKMLEQRGYQVYDVDADDHWGKPVLEVEAYKDGREYDIVLSYPDLKIIKEQLDR

SEQ ID NO: 2751 - DNA, 285 bp, Neisseria meningitidis
atgaaaaaactgttattggtcgccgttgtttccttgagtgccgcaaccgcatttgccggcgactctgccgagcgtcagatttacggcgatccctattttgaacaaaaccgcacaaaagccgtgaaaatgttggaacagcgcggttatcaggttcacgatgtcgatgccgacgaccattggggcaaacctgttttggaagtggaagcctataaagacggccgcgaatacgacattgtgttgtcttaccccgacctgaaaatcatcaaagagcagctcgatcgctga

SEQ ID NO: 2752 - protein, 94 aa, Neisseria meningitidis
MKKLLLVAVVSLSAATAFAGDSAERQIYGDPYFEQNRTKAVKMLEQRGYQVHDVDADDHWGKPVLEVEAYKDGREYDIVLSYPDLKIIKEQLDR

SEQ ID NO: 2753 - DNA, 495 bp, Neisseria gonorrhoeae
atgaaaaagaacatattggaattttgggtcggactgttcgtcttgatcggcgcggcggcggttgcctttctcgctttccgcgtggcgggcggcgcggcgttcggcggttcggacaaaacttacgccgtttatgccgatttcggcgacatcggcggtttgaaggtcaatgcccccgtcaaatccgcaggcgtattggtcgggcgcgtcggcgctatcgggcttgacccgaaatcctatcaggcgagggtgcgccttgatttggacggcaagtatcagttcagcagtgacgtttccgcgcaaatcctgacttcgggacttttgggcgaacagtacatcgggctgcagcagggcggcgatacggaaaaccttgctgccggcgacaccatctccgtaaccagttctgcaatggttctggaaaacctgatcggtaaattcatgaccagcttcgccgagaaaaacgctgagggcggcaatgcggaaaaagccgcagaataa

SEQ ID NO: 2754 - protein, 164 aa, Neisseria gonorrhoeae
MKKNILEFWVGLFVLIGAAAVAFLAFRVAGGAAFGGSDKTYAVYADFGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNAEGGNAEKAAE

SEQ ID NO: 2755 - DNA, 495 bp, Neisseria meningitidis
atgaagaagaacatattggaattttgggtcggactgttcgtcctgattggcgcggcggcggttgcctttctcgctttccgcgtggccggcggtgcggcgttcggcggttcggacaaaacttacgccgtttatgccgatttcggcgacatcggcggtttgaaggtcaatgcccccgtcaaatccgcaggcgtattggtcgggcgcgtcggcgctatcggacttgacccgaaatcctatcaggcgagggtgcgcctcgatttggacggcaagtatcagttcagcagcgacgtttccgcgcaaatcctgacttcgggacttttgggcgagcagtacatcgggctgcagcagggcggcgacacggaaaaccttgctgccggcgacaccatctccgtaaccagttctgcaatggttctggaaaaccttatcggcaaattcatgacgagttttgccgagaaaaatgccgacggcggcaatgcggaaaaagccgccgaataa

SEQ ID NO: 2756 - protein, 164 aa, Neisseria meningitidis
MKKNILEFWVGLFVLIGAAAVAFLAFRVAGGAAFGGSDKTYAVYADFGDIGGLKVNAPVKSAGVLVGRVGAIGLDPKSYQARVRLDLDGKYQFSSDVSAQILTSGLLGEQYIGLQQGGDTENLAAGDTISVTSSAMVLENLIGKFMTSFAEKNADGGNAEKAAE

SEQ ID NO: 2757 - DNA, 495 bp, Neisseria meningitidis
atgaaaaagaacatattggaattttgggtcggactgttcgtcctgattggcgcggcggcggttgcctttctcgctttccgcgtggccggcggtgcggcgttcggcggttcggacaaaacttacgccgtttatgccgatttcggcgacatcggcggtttgaaggtcaatgcccccgtcaaatccgcaggcgtattggtcgggcgcgtcggcgctatcggacttgacccgaaatcctatcaggcgagggtgcgcctcgatttggacggcaagtatcagttcagcagcgacgtttccgcgcaaatcctgacttcgggacttttgggcgagcagtacatcgggctgcagcagggcggcgacacggaaaaccttgctgccggcgacaccatctccgtaaccagttctgcaatggttctggaaaaccttatcggcaaattcatgacgagttttgccgagaaaaatgccgacggcggcaatgcggaaaaagccgccgaataa

SEQ ID NO: 2758 - protein, 164 aa, Neisseria meningitidis; identical to SEQ ID NO: 2756

SEQ ID NO: 2759 - DNA, 591 bp, Neisseria gonorrhoeae
gtgaaaaaatcctccttcatcagcgcattgggcatcggtattttgagcatcggcatggcatttgcctccccggccgacgcagtgggacaaatccgccaaaacgccacacaggttttgaccatcctcaaaagcggcgacgcggcttctgcacgcccaaaagccgaagcctatgcggttccctatttcgatttccaacgtatgaccgcattggcggtcggcaacccttggcgtaccgcgtccgacgcgcaaaaacaagcgttggccaaagaatttcaaaccctgctgatccgcacctattccggcacgatgctgaaattcaaaaacgcgaccgtcaacgtcaaagacaatcccatcgtcaataagggcggcaaggaaatcgtcgtccgtgccgaagtcggcatccccggtcagaagcccgtcaatatggactttaccacctaccaaagcggcggcaaataccgtacctacaacgtcgccatcgaaggcacgagcctggttaccgtgtaccgcaaccaattcggcgaaatcatcaaagccaaaggcatcgacgggctgattgccgagttgaaagccaaaaacggcggcaaataa

SEQ ID NO: 2760 - protein, 196 aa, Neisseria gonorrhoeae
VKKSSFISALGIGILSIGMAFASPADAVGQIRQNATQVLTILKSGDAASARPKAEAYAVPYFDFQRMTALAVGNPWRTASDAQKQALAKEFQTLLIRTYSGTMLKFKNATVNVKDNPIVNKGGKEIVVRAEVGIPGQKPVNMDFTTYQSGGKYRTYNVAIEGTSLVTVYRNQFGEIIKAKGIDGLIAELKAKNGGK

SEQ ID NO: 2761 - DNA, 591 bp, Neisseria meningitidis
atgaaaaaatcctccctcatcagcgcattgggcatcggtattttgagcatcggcatggcatttgccgcccctgccgacgcggtaagccaaatccgtcaaaacgccactcaagtattgagcatcttaaaaaacggcgatgccaacaccgctcgccaaaaagccgaagcctatgcgattccctatttcgatttccaacgtatgaccgcattggcggtcggcaacccttggcgcaccgcgtccgacgcgcaaaaacaagcgttggccaaagaatttcaaaccctgctgatccgcacctattccggcacgatgctgaaattaaaaaacgccaacgtcaacgtcaaagacaatcccatcgtcaataaaggcggcaaagaaatcatcgtccgcgccgaagtcggcgtacccgggcaaaaacccgtcaacatggacttcaccacctaccaaagcggcggtaaataccgtacctacaacgtcgccatcgaaggcgcgagcctggttaccgtgtaccgcaaccaattcggcgaaattatcaaagcgaaaggcgtggacggactgattgccgagttgaaagccaaaaacggcggcaaataa

SEQ ID NO: 2762 - protein, 196 aa, Neisseria meningitidis
MKKSSLISALGIGILSIGMAFAAPADAVSQIRQNATQVLSILKNGDANTARQKAEAYAIPYFDFQRMTALAVGNPWRTASDAQKQALAKEFQTLLIRTYSGTMLKLKNANVNVKDNPIVNKGGKEIIVRAEVGVPGQKPVNMDFTTYQSGGKYRTYNVAIEGASLVTVYRNQFGEIIKAKGVDGLIAELKAKNGGK

SEQ ID NO: 2763 - DNA, 591 bp, Neisseria meningitidis
atgaaaaaatcctccttcatcagcgcattgggcatcggtattttgagcatcggcatggcatttgccgcccctgccgacgcggtaaaccaaatccgtcaaaacgccactcaagtattgagcatcttaaaaagcggtgatgccaacaccgcccgccaaaaagccgaagcctatgcgattccctatttcgatttccaacgtatgaccgcattggcggtcggcaacccttggcgcaccgcgtccgacgcgcaaaaacaagcgttggccaaagaatttcaaaccctgctgatccgcacctattccggcacgatgctgaaattaaaaaacgccaacgtcaacgtcaaagacaatcccatcgtcaataaaggcggcaaagaaatcatcgtccgcgccgaagtcggcgtacccgggcaaaaacccgtcaacatggacttcaccacctaccaaagcggcggtaaataccgtacctacaacgtcgccatcgaaggcgcgagcctggttaccgtgtaccgcaaccaattcggcgaaattatcaaagcgaaaggcgtggacggactgattgccgagttgaaggctaaaaacggcagcaagtaa

SEQ ID NO: 2764 - protein, 196 aa, Neisseria meningitidis
MKKSSFISALGIGILSIGMAFAAPADAVNQIRQNATQVLSILKSGDANTARQKAEAYAIPYFDFQRMTALAVGNPWRTASDAQKQALAKEFQTLLIRTYSGTMLKLKNANVNVKDNPIVNKGGKEIIVRAEVGVPGQKPVNMDFTTYQSGGKYRTYNVAIEGASLVTVYRNQFGEIIKAKGVDGLIAELKAKNGSK

SEQ ID NO: 2765 - DNA, 834 bp, Neisseria gonorrhoeae
atgaaaaaaaccgcctacgccatcctcctgctgatcgggttcgcttccgcccctgcatttgcagaaacccgccccgccgacccttatgaaggctacaaccgcgccgtttccaaattcaacgaccaagccgaccgctacattttcgcccctgccgcgcgcggctaccgcaaagttacgccgaaacccgtccgcgccggcgtgtccaatttttttaacaacctgcgcgacgtggtcagtttcggcagcaatatcttgcgtttggacatcaaacgcgcaagcgaagacctcgtccgcgtcggcatcaataccaccttcggtttgggcgggctcattgatattgccggcgcgggcggcgttcccgacaataaaaacactttgggcgacacgtttgcctcgtggggctggaaaaacagcaattatttcgtgttgcccgtcttaggcccgtccaccgtccgcgacgcgctcggcacgggcattacctctgtttatccgcccaagaatatcgttttccatacccctgccggacgctggggcacgactgccgctgccgccgtcagtacgcgcgaaggcctcctcgatttgaccgacagtctggacgaagccgccatcgacaaatacagctacacgcgcgacctctatatgaaagtccgcgcacggcagaccggtgcaacacctgccgaaggtacggaagataacatcgacatcgacatcgacgaattggtcgaaagtgccgaaaccggcgcggcagagcccgccgttcacgaagattccgtatccgaaacacaggcagaagcagcaggggaagccgaaacgcaacctggaacacaaccctaa

SEQ ID NO: 2766 - protein, 277 aa, Neisseria gonorrhoeae
MKKTAYAILLLIGFASAPAFAETRPADPYEGYNRAVSKFNDQADRYIFAPAARGYRKVTPKPVRAGVSNFFNNLRDVVSFGSNILRLDIKRASEDLVRVGINTTFGLGGLIDIAGAGGVPDNKNTLGDTFASWGWKNSNYFVLPVLGPSTVRDALGTGITSVYPPKNIVFHTPAGRWGTTAAAAVSTREGLLDLTDSLDEAAIDKYSYTRDLYMKVRARQTGATPAEGTEDNIDIDIDELVESAETGAAEPAVHEDSVSETQAEAAGEAETQPGTQP

SEQ ID NO: 2767 - DNA, 828 bp, Neisseria meningitidis
atgaaaaaaaccgcctatgccttcctcctgctgatcgggttcgcttccgcccctgcatttgccgaaacccgccccgccgacccttatgaaggctacaaccgcgccgttttcaaattcaacgaccaagccgaccgctacattttcgcccctgccgcgcgcggctaccgcaaagttgcgccgaaacccgtccgcgccggcgtgtccaatttttttaacaacctgtgcgacgtggtcagcttcggcagcaatatcttgcgcttggacatcaaacgcgcaagcgaagaccttgtccgcgtcggcatcaacaccactttcggtttgggcgggcttatcgacatcgccggcgcgggcggcattcccgacaataaaaacaccttgggcgacacgtttgcctcgtggggatggaaaaacagcaattatttcgtgttgcccgtcttagggccgtccaccgtccgcgacgcgctcggcacgggtattacctccgtttattcgcccaagaatatcgtcttccgcacccctgtcggacgctggggcacgactgccgtatccgccgtcagtacgcgcgaaggcctgctcgatttgaccgacagtctggacgaagccgccatcgacaaatacagctacacgcgcgacctctatatgaaagtccgtgcgcggcagaccggtgcaacacctgccgaaggtacggaagataacatcgacatcgacgaattggtcgaaagtgccgaaaccggcgcggcggaaactgccgttcaagaagattccgtatccgaaacacaggcagaagcagcaggggaagccgaaacgcaacctggaacacaaccttaa

SEQ ID NO: 2768 - protein, 275 aa, Neisseria meningitidis
MKKTAYAFLLLIGFASAPAFAETRPADPYEGYNRAVFKFNDQADRYIFAPAARGYRKVAPKPVRAGVSNFFNNLCDVVSFGSNILRLDIKRASEDLVRVGINTTFGLGGLIDIAGAGGIPDNKNTLGDTFASWGWKNSNYFVLPVLGPSTVRDALGTGITSVYSPKNIVFRTPVGRWGTTAVSAVSTREGLLDLTDSLDEAAIDKYSYTRDLYMKVRARQTGATPAEGTEDNIDIDELVESAETGAAETAVQEDSVSETQAEAAGEAETQPGTQP

SEQ ID NO: 2769 - DNA, 840 bp, Neisseria meningitidis
atgaaaaaaaccgcctatgccttcctcctgctgatcgggttcgcttccgcccctgcatttgccgaaacccgccccgccgacccttatgaaggctacaaccgcgccgttttcaaattcaacgaccaagccgaccgctacattttcgcccctgccgcgcgcggctaccgcaaagttgcgccgaaacccgtccgcgccggcgtgtccaatttttttaacaacctgtgcgacgtggtcagcttcggcagcaatatcttgcgcttagacatcaaacgcgcaagcgaagaccttgtccgcgtcggtatcaacaccactttcggtttgggcgggcttatcgacatcgccggcgcgggcggcattcccgacaataaaaacaccttgggcgacacgtttgcttcgtggggatggaaaaacagcaattatttcgtgttgcccgtcttagggccgtccaccgtccgcgacgcgctcggcacgggtattacctccgtttattcgcccaagaatatcgtcttccgcacccctgtcggacgctggggcacgactgccgtatccgccgtcagtacgcgcgaaggcctgctcgatttgaccgacagtctggacgaagccgccatcgacaaatacagctacacgcgcgacctctatatgaaagtccgtgcgcggcagaccggtgcaacacctgccgaaggtacggaagataacatcgacatcgacgaattggtcgaaagtgccgaaaccggcgcggcggaaactgccgttcaagaagattccgtatccgaaacacaggcagaagcagcaggggaagccgaaacgcaacctggaacacaacctggaacacaaccttaa

SEQ ID NO: 2770 - protein, 279 aa, Neisseria meningitidis
MKKTAYAFLLLIGFASAPAFAETRPADPYEGYNRAVFKFNDQADRYIFAPAARGYRKVAPKPVRAGVSNFFNNLCDVVSFGSNILRLDIKRASEDLVRVGINTTFGLGGLIDIAGAGGIPDNKNTLGDTFASWGWKNSNYFVLPVLGPSTVRDALGTGITSVYSPKNIVFRTPVGRWGTTAVSAVSTREGLLDLTDSLDEAAIDKYSYTRDLYMKVRARQTGATPAEGTEDNIDIDELVESAETGAAETAVQEDSVSETQAEAAGEAETQPGTQPGTQP

SEQ ID NO: 2771 - DNA, 729 bp, Neisseria gonorrhoeae
atgaaaaaatgtattttgggcattttgaccgcgtgtgccgccatgcctgcatttgccgacagaatcagcgatttggaagcacgtctggcgcagttggaacaccgtgtcgccgtattggaaagcggcggcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcggagatgaggcaatccgatgcagaaaattcgattgatgtatcggttggacggataaagaaacggatacggagcttggcttccgtctctgtttttctctgcccgattttccatgcatcgggtttcagacggcattggagtgtcagtcgtgttctgccgattcgtaggcttcgacgattttttgcaccagaggatgccggacaacgtcttcgccggtgaaggtatggaaatacagtcctgccacgccgtgcagtttctcacgtgcgtctttcaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatatag

SEQ ID NO: 2772 - protein, 240 aa, Neisseria gonorrhoeae
MKKCILGILTACAAMPAFADRISDLEARLAQLEHRVAVLESGGNTVKIDLFGSNSTMYVCSVTPFQKTFEASDRNEGVARQKVRQACNRETSAMFCGDEAIRCRKFDCIGWTDKETDTELGFRLCFSLPDFPCIGFQTALECQSCSADSASTIFCTRGCRTTSSPVKVWKYSPATPCSFSRASFNPDLMFLGRSIWLVSPVMTAFAPKPMRVRNIFICSGVVFCASSRMMYAPLSVLPRI

SEQ ID NO: 2773 - DNA, 735 bp, Neisseria meningitidis
atgaaaaaatgtattttgggcattttgaccgcgtgtgccgccatgcctgcatttgccgacagaatcggcgatttggaagcacgtctggcgcagttggaacaccgtgtcgccgtattggaaagcggcggcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcgaagatgaggcaatccgatgcagaaaattcgattgatgtatcggttggacggataaagaaacggatacggatacggagcttggcttccgtatctgtttttctctgcctgattttccatgcatcgggtttcagacggcattggaatgtcagtcgtgttctgccgattcgtaggcttcgacgattttttgcaccaaaggatgccggacaacgtcttcgccggtaaaggtgtggaaatacagcccttccacgttgtgcagtttctcacgcgcatcttttaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatatag

SEQ ID NO: 2774 - protein, 244 aa, Neisseria meningitidis
  misc_feature (108)..(108): Xaa can be any naturally occurring amino acid
  misc_feature (153)..(153): Xaa can be any naturally occurring amino acid
MKKCILGILTACAAMPAFADRIGDLEARLAQLEHRVAVLESGGNTVKIDLFGSNSTMYVCSVTPFQKTFEASDRNEGVARQKVRQACNRETSAMFCEDEAIRCRKFDXCIGWTDKETDTDTELGFRICFSLPDFPCIGFQTALECQSCSADSXASTIFCTKGCRTTSSPVKVWKYSPSTLCSFSRASFNPDLMFLGRSIWLVSPVMTAFAPKPMRVRNIFICSGVVFCASSRMMYAPLSVLPRI

SEQ ID NO: 2775 - DNA, 729 bp, Neisseria meningitidis
atgaaaaaatgtattttgggcattttgaccgcgtgtgccgccatgcctgcatttgccgacagaatcggcgatttggaagcacgtctggcgcagttggaacaccgtgtcgccgtattggaaagcggcagcaataccgtcaaaatcgaccttttcggttcaaattccaccatgtatgtatgcagcgttacgccttttcagaagacgtttgaggcaagcgatcggaatgaaggcgtggcgcggcagaaagtgcgtcaggcgtgcaaccgcgaaacttcggcaatgttttgcgaagatgaggcaatccgatgcagaaaattcgattgatgtatcggttggacggataaagaaacggatacggagcttggcttccgtatctgtttttctctgcccgattttccatgcatcgggtttcagacggcattggaatgtcagtcgtgttctgccgattcgtaggcttcgacgattttttgcaccaaaggatgccggacaacgtcttcgccggtaaaggtgtggaaatacagcccttccacgccgtgcagtttctcacgcgcatcttttaatcccgatttgatgtttttgggcaggtcgatttggctggtgtcgccggtaatgacggctttcgcgccgaagccgatgcgggtcaggaacattttcatttgttcgggcgtggtgttttgcgcttcgtcgaggatgatgtatgcgccgttgagcgtcctgccgcgcatatag

SEQ ID NO: 2776 - protein, 240 aa, Neisseria meningitidis
MKKCILGILTACAAMPAFADRIGDLEARLAQLEHRVAVLESGSNTVKIDLFGSNSTMYVCSVTPFQKTFEASDRNEGVARQKVRQACNRETSAMFCEDEAIRCRKFDCIGWTDKETDTELGFRICFSLPDFPCIGFQTALECQSCSADSASTIFCTKGCRTTSSPVKVWKYSPSTPCSFSRASFNPDLMFLGRSIWLVSPVMTAFAPKPMRVRNIFICSGVVFCASSRMMYAPLSVLPRI

SEQ ID NO: 2777 - DNA, 495 bp, Neisseria gonorrhoeae; identical to SEQ ID NO: 1985

SEQ ID NO: 2778 - protein, 164 aa, Neisseria gonorrhoeae; identical to SEQ ID NO: 1986

SEQ ID NO: 2779 - DNA, 494 bp, Neisseria meningitidis
atgaaaaaaaccctgttggcaattgttgccgtttccgccttaagtgctgccggcaggcggaagagggaccgccgcctttaccccggcagattagcgaccgttcggtcggacactattgcagtatgaacctgaccgaacacaacggccccaaagcccagattttcttgaacggcaaacccgatcagcccgtttggttctccaccatcaagcagatgttcggctataccaagctgcccgaagagcctaaaggcatccgcgtgatttacgttaccgatatgggcaatgttaccgattggacgaatcccaatgccgacacggagtggatggatgcgaaaaaagccttttacgtcatcgacagcggctttatcggcggtatgggtgcggaagacgcgctgccgttcggcaacaaagagcaggctgagaaatttgcaaaggataaaggcggtaaggttgtcggtttcgacgatatgcctgatacctatattttcaaataa

SEQ ID NO: 2780 - protein, 164 aa, Neisseria meningitidis
  misc_feature (16)..(16): Xaa can be any naturally occurring amino acid
MKKTLLAIVAVSALSXCRQAEEGPPPLPRQISDRSVGHYCSMNLTEHNGPKAQIFLNGKPDQPVWFSTIKQMFGYTKLPEEPKGIRVIYVTDMGNVTDWTNPNADTEWMDAKKAFYVIDSGFIGGMGAEDALPFGNKEQAEKFAKDKGGKVVGFDDMPDTYIFK

SEQ ID NO: 2781 - DNA, 495 bp, Neisseria meningitidis; identical to SEQ ID NO: 1987

SEQ ID NO: 2782 - protein, 164 aa, Neisseria meningitidis; identical to SEQ ID NO: 1988

SEQ ID NO: 2783 - DNA, 1131 bp, Neisseria gonorrhoeae
atggtcaaacatctgccactcgccgtcctgactgctttgctgcttgcagcgtgcggcggttcggacaaaccgcctgccgaaaaaccggcaccggcggaaaaccaaaacgtattgaaaatttataactggtcggaatacgtcgatccggaaaccgttgccgattttgaaaagaaaaacggcatcaaggttacttatgatgtgtacgacagtgatgaaacgctggaaagcaaggtgctgaccggaaaatccggttacgacattgtcgcgccgtccaatgcgtttgtgggcaggcagattaaggcaggtgcgtatcagaaaatcgataagtcgatgattcccaattataaacatctcaaccctgaaatgatgaggctgatggacggggtcgatcccgaccacgaatacgccgtgccgttttattgggggacaaataccttcgccatcaataccgaacgcgtgaaaaaggctttgggtacggacaagctgccggacaaccagtgggatttggtgttcaaccccgaatacacgttcaaactcaaacaatgcggcatcagctatttggacagcgcggcggaaatttatcccatggtgttgaactatttgggcaaaaacccgaacagcagcaatacggaagacatcagggaggcaaccgccctgctcaagaaaaaccgccccaatatcaaacgctttacttcgtccggctttatcgatgatttggcgcgcggcgatacctgcgtaacaatcggtttcggcggagatttgaacatcgccaaacgccgtgccgaagaagcgggcggcaaggaaaaaatccgcgtgatgatgccgaaagagggcgtggggatttgggtggattctttcgtgattccgaaagatgcgaaaaacgtcgccaacgcgcacaaatacatcaacgacttcctcgatccggaagtgtcggcgaaaaacggcaatttcgttacctacgcgccttcgagcaagccggcgcgcgatttgatggaggacgaatttaaaaacgacaatacgattttcccgagcggggaagatttgaaaaacagctttatcatggtgcctatccggccggcggcattgaagtttatggtgcgccagtggcaggatgtgaaggcggggaaataa

SEQ ID NO: 2784 - protein, 376 aa, Neisseria gonorrhoeae
MVKHLPLAVLTALLLAACGGSDKPPAEKPAPAENQNVLKIYNWSEYVDPETVADFEKKNGIKVTYDVYDSDETLESKVLTGKSGYDIVAPSNAFVGRQIKAGAYQKIDKSMIPNYKHLNPEMMRLMDGVDPDHEYAVPFYWGTNTFAINTERVKKALGTDKLPDNQWDLVFNPEYTFKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARDLMEDEFKNDNTIFPSGEDLKNSFIMVPIRPAALKFMVRQWQDVKAGK

SEQ ID NO: 2785 - DNA, 1131 bp, Neisseria meningitidis
atgaccaaacatctgcccctggccgtcctgactgctttgctgcttgcagcgtgcggcggttcggacaaaccgcctgccgaaaaaccggcaccggcggaaaaccaaaacgtattgaaaatttacaactggtcggaatatgtcgatccggaaaccgttgccgattttgaaaagaaaaacggcatcaaggttacttatgatgtgtacgacagcgatgaaacgctggaaagcaaggtgctgacaggcaagtccggttacgacattgtcgcgccgtccaatgcgtttgtgggcaggcagattaaggcaggtgcgtatcagaaaatcgataagtcgctgattcccaattataaacacctcaaccccgaaatgatgaggctgatggacggggtcgatcccggccacgaatacgccgtgccgttttattgggggacaaataccttcgccatcaataccgaacgcgtgaaaaaggctttgggtacggacaagctgccggacaaccagtgggatttggtgttcgaccccgaatacacgtccaaactcaagcaatgcggcatcagctatttggacagcgcggcggaaatctatcctatggtgttgaactatttgggtaaaaacccgaacagcagcaatacggaagacatcagggaggcaaccgccctactcaagaaaaaccgccccaatatcaaacgctttacttcgtccggctttatcgatgatttggcgcgcggcgatacctgcgtaacaatcggtttcggcggcgatttgaacatcgccaaacgccgtgccgaagaagcgggcggcaaggaaaaaatccgcgtgatgatgcccaaagagggcgtggggatttgggtggattctttcgtgattccgaaagatgcgaaaaacgtcgccaacgcgcacaaatacatcaacgacttcctcgacccggaagtgtcggcgaaaaacggcaatttcgttacttacgcgccttcgagcaagcctgcgcgtgagctgatggaagacgaatttaaaaacgacaatacgattttcccaaccgaggaggatttgaaaaacagctttatcatggtgcctatccagccggcggcattgaagtttatggtgcgccagtggcaggatgtgaaggcggggaaataa

SEQ ID NO: 2786 - protein, 376 aa, Neisseria meningitidis
MTKHLPLAVLTALLLAACGGSDKPPAEKPAPAENQNVLKIYNWSEYVDPETVADFEKKNGIKVTYDVYDSDETLESKVLTGKSGYDIVAPSNAFVGRQIKAGAYQKIDKSLIPNYKHLNPEMMRLMDGVDPGHEYAVPFYWGTNTFAINTERVKKALGTDKLPDNQWDLVFDPEYTSKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARELMEDEFKNDNTIFPTEEDLKNSFIMVPIQPAALKFMVRQWQDVKAGK

SEQ ID NO: 2787 - DNA, 1131 bp, Neisseria meningitidis
atgaccaaacatctgcccctggccgtcctgactgctttgctgcttgcagcgtgcggcggttcggacaaaccgcctgccgaaaaaccggcgccggcggaaaaccgaaacgtattgaaaatttacaactggtcggaatacgtcgatccggaaaccgttgccgattttgaaaagaaaaacggcatcaaggttacttatgatgtgtacgacagcgatgaaacgctggaaagcaaggtgctgaccggaaaatctggttacgacattgtcgcgccgtccaatgcgtttgtgggcaggcagattaaggcaggtgcgtatcagaaaatcgataagtcgctgattcccaattataaacacctcaaccccgaaatgatgaggctgatggacggggtcgatcccggccacgaatacgccgtgccgttttattgggggacaaataccttcgccatcaataccgaacgcgtgaaaaaggctttgggtacggacaagctgccggacaaccagtgggatttggtgttcgaccccgaatacacgtccaaactcaagcaatgcggcatcagctatttggacagcgcggcggaaatctatcctatggtgttgaactatttgggtaaaaacccgaacagcagcaatacggaagacatcagggaggcaaccgccctactcaagaaaaaccgccccaatatcaaacgctttacttcgtccggctttatcgatgatttggcgcgcggcgatacctgcgtaacaatcggtttcggcggcgatttgaacatcgccaaacgccgtgccgaagaagcgggcggcaaggaaaaaatccgcgtgatgatgcccaaagagggcgtggggatttgggtggattctttcgtgattccgaaagatgcgaaaaacgtcgccaacgcgcacaaatacatcaacgacttcctcgacccggaagtgtcggcgaaaaacggcaatttcgttacttacgcgccttcgagcaagcctgcgcgtgagctgatggaagacgaatttaaaaacgacaatacgattttcccaaccgaggaggatttgaaaaacagctttatcatggtgcctatccagccggcggcattgaagtttatggtgcgccagtggcaggatgtgaaggcggggaaataa

SEQ ID NO: 2788 - protein, 376 aa, Neisseria meningitidis
MTKHLPLAVLTALLLAACGGSDKPPAEKPAPAENRNVLKIYNWSEYVDPETVADFEKKNGIKVTYDVYDSDETLESKVLTGKSGYDIVAPSNAFVGRQIKAGAYQKIDKSLIPNYKHLNPEMMRLMDGVDPGHEYAVPFYWGTNTFAINTERVKKALGTDKLPDNQWDLVFDPEYTSKLKQCGISYLDSAAEIYPMVLNYLGKNPNSSNTEDIREATALLKKNRPNIKRFTSSGFIDDLARGDTCVTIGFGGDLNIAKRRAEEAGGKEKIRVMMPKEGVGIWVDSFVIPKDAKNVANAHKYINDFLDPEVSAKNGNFVTYAPSSKPARELMEDEFKNDNTIFPTEEDLKNSFIMVPIQPAALKFMVRQWQDVKAGK

SEQ ID NO: 2789 - DNA, 1326 bp, Neisseria gonorrhoeae
atgaaaaaacacctgctccgctccgccctgtacggcatcgccgccgccatcctcgccgcctgccaaagcaggagcatccaaacctttccgcaacccgacacatccgtcatcaacggcccggaccggccggccggcatccccgaccccgccggaacgacggttgccggcggcggggccgtctataccgttgtgccgcacctgtccatgccccactgggcggcgcaggattttgccaaaagcctgcaatccttccgcctcggctgcgccaatttgaaaaaccgccaaggctggcaggatgtgtgcgcccaagcctttcaaacccccgtgcattcctttcaggcaaagcggttttttgaacgctatttcacgccgtggcaggttgcaggcaacggaagccttgcaggtacggttaccggctattacgaaccggtgctgaagggcgacggcaggcggacggaacgggcccgcttcccgatttacggtattcccgacgattttatctccgtcccgctgcctgccggtttgcggggcggaaaaaaccttgtccgcatcaggcagacggggaaaaacagcggcacgatcgacaatgccggcggcacgcataccgccgacctctcccgattccccatcaccgcgcgcacaacggcaatcaaaggcaggtttgaaggaagccgcttcctcccttaccacacgcgcaaccaaatcaacggcggcgcgcttgacggcaaagcccccatcctcggttacgccgaagaccccgtcgaactttttttcatgcacatccaaggctcgggccgcctgaaaaccccgtccggcaaatacatccgcatcggatacgccgacaaaaacgaacatccgtatgtttccatcggacgctatatggcggacaaaggctacctcaagctcgggcagacctcgatgcagggcatcaaagcctatatgcggcaaaatccgcaacgcctcgccgaagttttgggtcaaaaccccagctatatctttttccgcgagcttgccggaagcggcaatgagggccccgtcggcgcactgggcacgccactgatgggggaatacgccggcgcaatcgaccggcactacattaccttgggcgcgcccttatttgtcgccaccgcccatccggttacccgcaaagccctcaaccgcctgattatggcgcaggatacaggcagcgcgatcaaaggcgcggtgcgcgtggattatttttggggttacggcgacgaagccggcgaacttgccggcaaacagaaaaccacgggatacgtctggcagctcctgcccaacggcatgaagcccgaataccgcccgtga

SEQ ID NO: 2790 - protein, 441 aa, Neisseria gonorrhoeae
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPVHSFQAKRFFERYFTPWQVAGNGSLAGTVTGYYEPVLKGDGRRTERARFPIYGIPDDFISVPLPAGLRGGKNLVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSGNEGPVGALGTPLMGEYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 2791 - DNA, 1326 bp, Neisseria meningitidis
atgaaaaaatacctattccgcgccgccctgtacggcatcgccgccgccatcctcgccgcctgccaaagcaagagcatccaaacctttccgcaacccgacacatccgtcatcaacggcccggaccggccggtcggcatccccgaccccgccggaacgacggtcggcggcggcggggccgtctataccgttgtaccgcacctgtccctgccccactgggcggcgcaggatttcgccaaaagcctgcaatccttccgcctcggctgcgccaatttgaaaaaccgccaaggctggcaggatgtgtgcgcccaagcctttcaaacccccgtccattcctttcaggcaaaacagttttttgaacgctatttcacgccgtggcaggttgcaggcaacggaagccttgccggtacggttaccggctattacgaaccggtgctgaagggcgacgacaggcggacggcacaagcccgcttcccgatttacggtattcccgacgattttatctccgtccccctgcctgccggtttgcggagcggaaaagcccttgtccgcatcaggcagacgggaaaaaacagcggcacaatcgacaataccggcggcacacataccgccgacctctcccgattccccatcaccgcgcgcacaacagcaatcaaaggcaggtttgaaggaagccgcttcctcccctaccacacgcgcaaccaaatcaacggcggcgcgcttgacggcaaagccccgatactcggttacgccgaagaccctgtcgaacttttttttatgcacatccaaggctcgggccgtctgaaaaccccgtccggcaaatacatccgcatcggctatgccgacaaaaacgaacatccytacgtttccatcggacgctatatggcggataagggctacctcaaactcggacaaacctccatgcagggcattaagtcttatatgcggcaaaatccgcaacgcctcgccgaagttttgggtcaaaaccccagctatatctttttccgcgagcttgccggaagcagcaatgacggccctgtcggcgcactgggcacgccgctgatgggggaatatgccggcgcagtcgaccggcactacattaccttgggtgcgcccttatttgtcgccaccgcccatccggttacccgcaaagccctcaaccgcctgattatggcgcaggataccggcagcgcgattaaaggcgcggtgcgcgtggattatttttggggatacggcgacgaagccggcgaacttgccggcaaacagaaaaccacgggatatgtctggcagctcctacccaacggtatgaagcccgaataccgcccgtaa

SEQ ID NO: 2792 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2793 - DNA, 1326 bp, Neisseria meningitidis
atgaaaaaatacctattccgcgccgccctgtgcggcatcgccgccgccatcctcgccgcctgccaaagcaagagcatccaaacctttccgcaacccgacacatccgtcatcaacggcccggaccggccggtcggcatccccgaccccgccggaacgacggtcggcggcggcggggccgtttataccgttgtgccgcacctgtccctgccccactgggcggcgcaggatttcgccaaaagcctgcaatccttccgcctcggctgcgccaatttgaaaaaccgccaaggctggcaggatgtgtgcgcccaagcctttcaaacccccgtccattccgttcaggcaaaacagttttttgaacgctatttcacgccgtggcaggttgcaggcaacggaagccttgccggtacggttaccggctattacgagccggtgctgaagggcgacgacaggcggacggcacaagcccgcttcccgatttacggtattcccgacgattttatctccgtccccctgcctgccggtttgcggagcggaaaagcccttgtccgcatcaggcagacgggaaaaaacagcggcacaatcgacaataccggcggcacacataccgccgacctctcccaattccccatcactgcgcgcacaacggcaatcaaaggcaggtttgaaggaagccgcttcctcccctaccacacgcgcaaccaaatcaacggcggcgcgcttgacggcaaagccccgatactcggttacgccgaagaccccgtcgaacttttttttatgcacatccaaggctcgggccgtctgaaaaccccgtccggcaaatacatccgcatcggctatgccgacaaaaacgaacatccctacgtttccatcggacgctatatggcggacaaaggctacctcaagctcgggcagacctcgatgcagggcatcaaagcctatatgcagcaaaacccgcaacgcctcgccgaagttttggggcaaaaccccagctatatctttttccgagagcttaccggaagcagcaatgacggccctgtcggcgcactgggcacgccgctgatgggcgagtacgccggcgcagtcgaccggcactacattaccttgggcgcgcccttatttgtcgccaccgcccatccggttacccgcaaagccctcaaccgcctgattatggcgcaggataccggcagcgcgattaaaggcgcggtgcgcgtggattatttttggggatacggcgacgaagccggcgaacttgccggcaaacagaaaaccacgggatatgtctggcagcttctgcccaacggtatgaagcccgaataccgcccgtaa

SEQ ID NO: 2794 - protein, 441 aa, Neisseria meningitidis
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 2795 - DNA, 624 bp, Neisseria gonorrhoeae
ccgatgcagctggttaccgaaaaaggtaaggaaaacatgattcaacgcggcacatacaactaccaataccgcagcaaccgtcccgtcaaagacggcagctacctcgttaccgccgaatatcagcctactttccggtcaaaaaacaaagcaggctggaaacaggctggcatcaaagaaatgcctgacgcaagctattgcgaacaaacccgtatgttcggtaaaaacattgtcaacgtgggacacgaaagcgcggacaccgccatcatcaccaaaccggtcggacaaaacttggaaatcgtcccgctggacaatcccgccgacattcacgtgggctaacgcttcaaagtccgcgttctgttccgtggcgaaccgctgcccaatgccaccgttaccgctacatttgacggcttcgacaccagcgaccgcagcaaaacgcacaaaaccgaagcccaagccttctccgacaccaccgacggcgaaggcgaagtggacatcatccccttgcgccaaggcttttggaaagcgagtgtcgaatacaaagccgatttccccgatcaaagcctgtgccgaaaacaggcgaactacacaactttaaccttccaaatcgcccattctcaccattaa

SEQ ID NO: 2796 - protein, 207 aa, Neisseria gonorrhoeae
  misc_feature (112)..(112): Xaa can be any naturally occurring amino acid
PMQLVTEKGKENMIQRGTYNYQYRSNRPVKDGSYLVTAEYQPTFRSKNKAGWKQAGIKEMPDASYCEQTRMFGKNIVNVGHESADTAIITKPVGQNLEIVPLDNPADIHVGXRFKVRVLFRGEPLPNATVTATFDGFDTSDRSKTHKTEAQAFSDTTDGEGEVDIIPLRQGFWKASVEYKADFPDQSLCRKQANYTTLTFQIAHSHH

SEQ ID NO: 2797 - DNA, 807 bp, Neisseria meningitidis
atgaagaaaacattgacactgctctccgtttccgccctatttgccacatccgcccacgcccaccgmgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaawacaaagcaggctggaaacaggcgggcatcaaagaaatgcctgacgcaagctattgcgaacaaacccgaatgttcggcaaaaacatcgtcaacgtcggacacgaaagcgcggacaccgccatcatcaccaarccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaawmccgaagcacaggctttctccgacagcacagacgacaaaggcgaagtggacatcatcmccttgcgccaaggcttctggaaagccaatgtcgaacacaaaaccgacttccccgatcaaagcgtgtgccaaaaacaggcgaactactcgactttaaccttccaaatcggtcattcgcaccattaa

SEQ ID NO: 2798 - protein, 268 aa, Neisseria meningitidis
  misc_feature (109)..(109): Xaa can be any naturally occurring amino acid
  misc_feature (208)..(209): Xaa can be any naturally occurring amino acid
  misc_feature (228)..(228): Xaa can be any naturally occurring amino acid
MKKTLTLLSVSALFATSAHAHRVWVETAHTHGGEYLKADLGYGEFPELEPIAKDRLHIFSKPMQLVTEKGKENMIQRGTYNYQYRSNRPVKDGSYLVIAEYQPTFWSKXKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHXXEAQAFSDSTDDKGEVDIIXLRQGFWKANVEHKTDFPDQSVCQKQANYSTLTFQIGHSHH

SEQ ID NO: 2799 - DNA, 807 bp, Neisseria meningitidis
tgaaagaaaacattgacactgctcgccgtttccgccctatttgccgcatccgcccacgcccaccgcgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaaaacaaagcaggctggaaacaggcgggcatcaaacaaatgcctgacgcaagctattgcgaacaaacccgaatgttcggcaaaaacatcgtcaacgtcggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaaaaccgaagcacaggctttctccgacagcacagacgacaaaggcgaagtggacatcatccccttgcgccaaggcttctggaaagccaatgtcgaacacaaagccgacttccccgatcaaagcgtgtgccaaaaacaggcgaactactcgactttaaccttccaaatcggccattcgcaccattaa

SEQ ID NO: 2800 - protein, 267 aa, Neisseria meningitidis
KKTLTLLAVSALFAASAHAHRVWVETAHTHGGEYLKADLGYGEFPELEPIAKDRLHIFSKPMQLVTEKGKENMIQRGTYNYQYRSNRPVKDGSYLVIAEYQPTFWSKNKAGWKQAGIKQMPDASYCEQTRMFGKNIVNVGHESADTAIITKPVGQNLEIVPLDNPANIHVGERFKVRVLFRGEPLPNATVTATFDGFDTSDRSKTHKTEAQAFSDSTDDKGEVDIIPLRQGFWKANVEHKADFPDQSVCQKQANYSTLTFQIGHSHH

SEQ ID NO: 2801 - DNA, 807 bp, Neisseria gonorrhoeae
atgaagaaaacattgacactgctcgccgtttccgcactatttgccacatccgcacacccccaccgcgtctgggtcgaaaccgcccacacgcacggcggcgaataccttaaagccgacttgggctacggcgaattccccgaactcgaacccatcgccaaagaccgcctgcacatcttcagcaaaccgatgcagctggttaccgaaaaaggtaaggaaaacatgattcaacgcggcacatacaactaccaataccgcagcaaccgtcccgtcaaagacggcagctacctcgttaccgccgaatatcagcctactttccggtcaaaaaacaaagcaggctggaaacaggctggcatcaaagaaatgcctgacgcaagctattgcgaacaaacccgtatgttcggtaaaaacattgtcaacgtgggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgctacatttgacggcttcgacaccagcgaccgcagcaaaacgcacaaaaccgaagcccaagccttctccgacaccaccgacggcaaaggcgaagtggacatcatccccttgcgccaaggcttttggaaagcgagtgtcgaatacaaagccgatttccccgatcaaagcctgtgccaaaaacaggcgaactacacaactttaaccttccaaatcggccattctcaccattaa

SEQ ID NO: 2802 - protein, 268 aa, Neisseria meningitidis
MKKTLTLLAVSALFATSAHPHRVWVETAHTHGGEYLKADLGYGEFPELEPIAKDRLHIFSKPMQLVTEKGKENMIQRGTYNYQYRSNRPVKDGSYLVTAEYQPTFRSKNKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHKTEAQAFSDTTDGKGEVDIIPLRQGFWKASVEYKADFPDQSLCQKQANYTTLTFQIGHSHH

SEQ ID NO: 2803 - DNA, 807 bp, Neisseria meningitidis
atgaagaaaacattgacactgctcgccgtttccgccctatttgccacatccgcccacgcccaccgcgtctgggtcgaaaccgcccacacgcacggcggcgaataccttaaagccgacttgggctacggcgaatttcccgaactcgaacccatcgccaaagaccgcctgcacatcttcagcaaaccgatgcagctggttaccgaaaaaggcaaggaaaacatgattcaacgcggcacatacaactaccagtaccgaagcaaccgtcccgttaaggacggcagttacctcgtcatcgccgaatatcagcctactttctggtcaaaaaacaaagcaggctggaaacaggcgggcatcaaagaaatgcctgacgcaagctattgcgaacaaacccgaatgttcggcaaaaacatcgtcaacgtcggacacgaaagcgcggacaccgccatcatcaccaaaccggtcggacaaaacttggaaatcgtcccgctggacaatcccgccaacattcacgtaggcgaacgcttcaaagtccgcgttctgttccgtggcgaaccgctgcccaatgccaccgttaccgccacctttgacggcttcgacaccagcgaccgcagcaaaacgcacaaaaccgaagcacaggctttctccgacagcacagacgacaaaggcgaagtggacatcatccccttgcgccaaggcttctggaaagccaatgtcgaacacaaaaccgacttccccgatcaaagcgtgtgccaaaaacaggcgaactactcgactttaaccttccaaatcggtcattcgcaccattaa

SEQ ID NO: 2804 - protein, 268 aa, Neisseria meningitidis
MKKTLTLLAVSALFATSAHAHRVWVETAHTHGGEYLKADLGYGEFPELEPIAKDRLHIFSKPMQLVTEKGKENMIQRGTYNYQYRSNRPVKDGSYLVIAEYQPTFWSKNKAGWKQAGIKEMPDASYCEQTRMFGKNIVNVGHESADTAIITKPVGQNLEIVPLDNPANIHVGERFKVRVLFRGEPLPNATVTATFDGFDTSDRSKTHKTEAQAFSDSTDDKGEVDIIPLRQGFWKANVEHKTDFPDQSVCQKQANYSTLTFQIGHSHH

SEQ ID NO: 2805 - DNA, 807 bp, Neisseria meningitidis; identical to SEQ ID NO: 2799

SEQ ID NO: 2806 - protein, 267 aa, Neisseria gonorrhoeae; identical to SEQ ID NO: 2800

SEQ ID NO: 2807 - DNA, 489 bp, Neisseria gonorrhoeae
atgaaaaaataccttatccctctttccattgcggcagtcctttccgggtgccagtctatttatgtgcccacattgacggaaatccccgtgaatcccatcaataccgtcaaaacggaagcacctgcaaaaggttttcgcctcgccccttcgcattgggcggatgttgccaaaatcagcgatgaagcgacgcgcttgggctatcaggtgggtatcggtaaaatgaccaaggttcaggcggcgcaatatctgaacaacttcagaaaacgcctggtcggacgcaatgccgtcgatgacagtatgtatgaaatctacctgcgttcggcggtagacagccagcgcggcgaaatcaatacggaacagtccaagctgtatatcgagaatgccttgcgcggctggcagcagcgttggaaaaatatggatgccaaacccgataatcccgcatttaccaactttttgatggaagtgatgaagatgcagcccttgaaatga

SEQ ID NO: 2808 - protein, 162 aa, Neisseria meningitidis
MKKYLIPLSIAAVLSGCQSIYVPTLTEIPVNPINTVKTEAPAKGFRLAPSHWADVAKISDEATRLGYQVGIGKMTKVQAAQYLNNFRKRLVGRNAVDDSMYEIYLRSAVDSQRGEINTEQSKLYIENALRGWQQRWKNMDAKPDNPAFTNFLMEVMKMQPLK

SEQ ID NO: 2809 - DNA, 489 bp, Neisseria meningitidis
atgaaaaaataccttatccctctttccattgcggcagttctttccggctgccagtctatttatgtgcccacattgacggaaatccccgtgaatcctatcaataccgtcaaaacggaagcacctgcaaaaggtttccgccttgcctcttcgcattggacggatgttgccaaaatcagcgatgaagcgacgcgcttgggctatcaggtgggtatcggtaaaatgaccaaggttcaggcggcgcaatatctgaacaacttcagaaaacgcctggtcggacgcaatgccgtcgatgacagtatgtatgaaatctacctgcgttcggcgatagacagccagcggggcgcaatcaatacggaacagtccaagctgtatatccagaatgccttgcgcggctggcagcagcgttggaaaaatatggatgtcaaacccaacaaccccgcatttaccaactttttgatggaagtgatgaagatgcagcccttgaaatga

SEQ ID NO: 2810 - protein, 162 aa, Neisseria meningitidis
MKKYLIPLSIAAVLSGCQSIYVPTLTEIPVNPINTVKTEAPAKGFRLASSHWTDVAKISDEATRLGYQVGIGKMTKVQAAQYLNNFRKRLVGRNAVDDSMYEIYLRSAIDSQRGAINTEQSKLYIQNALRGWQQRWKNMDVKPNNPAFTNFLMEVMKMQPLK

SEQ ID NO: 2811 - DNA, 489 bp, Neisseria meningitidis
atgaaaaaataccttatccctctttccattgtggcagttctttccggctgccagtctatttatgtgcccacattgacggaaatccccgtgaatcctatcaataccgtcaaaacggaagcacctgcaaaaggtttccgccttgcctcttcgcattggacggatgttgccaaaatcagcgatgaagcgacgcgcttgggctatcaggtgggtatcggtaaaatgaccaaggttcaggcggcgcaatatctgaacaacttcagaaaacgcctggtcggacgcaatgccgtcgatgacagtatgtatgaaatctacctgcgttcggcgatagacagccagcggggcgcaatcaatacggaacagtccaagctgtatatccagaatgccttgcgcggctggcagcagcgttggaaaaatatggatgtcaaacccaacaaccccgcatttaccaactttttgatggaagtgatgaagatgcagcccttgaaatga

SEQ ID NO: 2812 - protein, 162 aa, Neisseria gonorrhoeae
MKKYLIPLSIVAVLSGCQSIYVPTLTEIPVNPINTVKTEAPAKGFRLASSHWTDVAKISDEATRLGYQVGIGKMTKVQAAQYLNNFRKRLVGRNAVDDSMYEIYLRSAIDSQRGAINTEQSKLYIQNALRGWQQRWKNMDVKPNNPAFTNFLMEVMKMQPLK

SEQ ID NO: 2813 - DNA, 1092 bp, Neisseria gonorrhoeae
atggaaaagagaaaaatactgccgctggcaatttgtttggcggctttgtctgcctgtacggcgatggaggcccgcacaccccgggcaaatgaagcccaagccccccgcgcggatgaaatgaaaaaagaaagccgccccgcgtttgacgcggcagccgtaccggtatccgacagcgggtttgccgccaatgcaaatgtccgccgttttgtggacgatgaagtcgggaaaggggatttttcccaggcggaatggcaggatttttttgacaaagcggcttacaaggcggacatcgtcaagattatgcaccgaccctccacatcgcgtccgtggtatgtgttccgcacgggaaattcgggcagggcgaaatttcacggcgcgcgcaggttttatgcggaaaaccgcgcggttatcgatgatgtggcgcaaaaatacggcgtgcctgccgagcttatcgtggcgattatcgggattgaaacgaattacggcaaaaatacgggcagtttccgtgtggcggacgcattggcgactttaggctttgattatccccgccgcgccgggtttttccaaaaagaattggtcgagcttttaaagctggcaaaagaagaaggcggtgatgttttcgcctttaagggcagctatgcgggtgcaatgggtatgccgcaatttatgccttcgagctaccggaaatgggcggtggattatgacggggacggacatcgggatatatggggcaacgtcggtgatgtcgcggcatcggttgccaattatatgaagcagcacggttggcgcacgggcggtaaaatgttggtgtcggcgacgttggcgccgggtgcggatgttcaggcaatcattggcgaaaaaaccgccctgacgcggacggtggcggatttgaaggcgtacggcatcatccccggggaaacgctcgcagatgatgaaaaggcggttttgttcaaactggaaaccgcacccggcgtgtttgaatattatttgggcttgaacaatttttatacggtatggcagtacaaccacagccggatgtatgtaacggcggtcagggacattgccaattcgctcggcggcccgggattgtaa

SEQ ID NO: 2814 - protein, 363 aa, Neisseria meningitidis
MEKRKILPLAICLAALSACTAMEARTPRANEAQAPRADEMKKESRPAFDAAAVPVSDSGFAANANVRRFVDDEVGKGDFSQAEWQDFFDKAAYKADIVKIMHRPSTSRPWYVFRTGNSGRAKFHGARRFYAENRAVIDDVAQKYGVPAELIVAIIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASVANYMKQHGWRTGGKMLVSATLAPGADVQAIIGEKTALTRTVADLKAYGIIPGETLADDEKAVLFKLETAPGVFEYYLGLNNFYTVWQYNHSRMYVTAVRDIANSLGGPGL

SEQ ID NO: 2815 - DNA, 1110 bp, Neisseria meningitidis
atgaaaaagagaaaaatactgccgctggcaatttgtttggcggctttgtctgcctgtacggcgatggaggcacgcccaccccgggcaaatgaagcccaagccccccgcgcggttgaaatgaaaaaagaaagccgccccgcgtttgacgcggcagccgtatttgacgcggcagccgtaccggtatccgacagcgggtttgccgccaatgcaaatgtccgccgttttgtggacgatgaagtcgggaaaggggatttttcccgggcggaatggcaggatttttttgacaaagcggcttacaaggcggacatcgtcaagattatgcaccgcccctccacatcgcgtccgtggtatgtgttccgcacgggaaattcgggcaaggcgaaatttcgcggcgcgcgccggttttatgcggaaaaccgcgcgcttatcgatgatgtggcgcaaaaatacggcgtgcctgccgaacttatcgtggcggttatcgggattgaaacgaattacggcaaaaatacgggcagtttccgtgtggcggacgcattggcgaccttaggctttgattacccccgccgcgccgggtttttccaaaaagaattggtcgagcttttaaagctggcaaaagaagaaggcggcgatgttttcgcctttaaaggcagctatgcgggcgcaatggggatgccgcaatttatgccttcgagctaccggaaatgggcggtggattatgacggggacggacatcgggacatatggggcaacgtcggcgatgtcgcggcatcggttgccaattatatgaagcagcacggttggcgcacgggcgggaaaatgctggtgtctgcaacattggcgccgggtgcggatgttcaggcaatcattggcgaaaaaaccgccctgacgcggacggtggcggatttgaaggcgtacggcatcatccccggcgaagagcttgcagatgatgaaaaggcggttttgttcaaactggaaaccgcaccgggcgtgtttgaatattatttgggcttgaacaatttttatacggtatggcagtacaaccacagccggatgtatgtaacggcggtcagggacattgccaattcgcttggcggcccgggattgtaa

SEQ ID NO: 2816 - protein, 369 aa, Neisseria meningitidis
MKKRKILPLAICLAALSACTAMEARPPRANEAQAPRAVEMKKESRPAFDAAAVFDAAAVPVSDSGFAANANVRRFVDDEVGKGDFSRAEWQDFFDKAAYKADIVKIMHRPSTSRPWYVFRTGNSGKAKFRGARRFYAENRALIDDVAQKYGVPAELIVAVIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASVANYMKQHGWRTGGKMLVSATLAPGADVQAIIGEKTALTRTVADLKAYGIIPGEELADDEKAVLFKLETAPGVFEYYLGLNNFYTVWQYNHSRMYVTAVRDIANSLGGPGL

SEQ ID NO: 2817 - DNA, 1110 bp, Neisseria meningitidis
atgaaaaacagaaaaatactgccgctggcaatttgtttggcggctttgtctgcctgtacggcgatggaggcacgcccgccccgggcaaatgaagcccaagccccccgcgcggatgaaatgaaaaaagaaagccgccccgcgtttgacgcggcagccgtatttgacgcggcagccgtaccggtatccgacagcgggtttgccgccaatgcaaatgtccgccgttttgtggacgatgaagtcgggaaaggggatttttcccgggcggaatggcaggatttttttgacaaagcggcttacaaggcggacatcgtcaagattatgcaccgcccctccacatcgcgtccgtggtatgtgttccgcacgggaaattcgggcaaggcgaaatttcgcggcgcgcgccggttttatgcggaaaaccgcgcgcttatcgatgatgtggcgcaaaaatacggcgtgcctgccgaacttatcgtggcggttatcgggattgaaacgaattacggcaaaaatacgggcagtttccgtgtggcggacgcattggcgaccttaggctttgattacccccgccgcgccgggtttttccaaaaagaattggtcgagcttttaaagctggcaaaagaagaaggcggcgatgttttcgcctttaaaggcagctatgcgggcgcaatggggatgccgcaatttatgccttcgagctaccggaaatgggcggtggattatgacggggacggacatcgggacatatggggcaatgttggcgatgtcgcggcatcgattgccaattatatgaagcagcacggttggcgcacgggcgggaaaatactggtgtctgcaacattggcgccgggtgcggatgttcaggcaatcattggcgaaaaaaccgccctgacgcggacggtggcggatttgaaggcgtacggcatcatccccggcgaagagcttgccgatgatgaaaaggcggttttgttcaaactggaaaccgcacccggcgtgtttgaatattatttgggcttgaacaatttttatacggtatggcagtacaatcacagtcggatgtatgtaacggcggtcagggacattgccaattcgcttggcggcccgggattgtaa

SEQ ID NO: 2818 - protein, 369 aa, Neisseria gonorrhoeae
MKNRKILPLAICLAALSACTAMEARPPRANEAQAPRADEMKKESRPAFDAAAVFDAAAVPVSDSGFAANANVRRFVDDEVGKGDFSRAEWQDFFDKAAYKADIVKIMHRPSTSRPWYVFRTGNSGKAKFRGARRFYAENRALIDDVAQKYGVPAELIVAVIGIETNYGKNTGSFRVADALATLGFDYPRRAGFFQKELVELLKLAKEEGGDVFAFKGSYAGAMGMPQFMPSSYRKWAVDYDGDGHRDIWGNVGDVAASIANYMKQHGWRTGGKILVSATLAPGADVQAIIGEKTALTRTVADLKAYGIIPGEELADDEKAVLFKLETAPGVFEYYLGLNNFYTVWQYNHSRMYVTAVRDIANSLGGPGL

SEQ ID NO: 2819 - DNA, 372 bp, Neisseria gonorrhoeae
atgaagcggcaggctttcttcaaaccgatggcgtgtgcggcatttctgtccgccgtttcgctgcgcctccccgtattgggcgcgtgttacgcaatattgtccctctatgcgtttgcactttacggcatcgacaaacggcgtgccgtgcggggaaaacgccgcattcccgaacaccgcctgctcctgcctgccttgttcggcggttggacgggcgcatacttgggtagtaggatgttcaggcataaaacggcgaaaaagcgttttgttgtgctgttccgtctgactgtttcgggcaatgtcctggcgacctgcatcctgattgattatttcgttccgcccgaactttttgtaaaactcgggcaacatctctga

SEQ ID NO: 2820 - protein, 123 aa, Neisseria meningitidis
MKRQAFFKPMACAAFLSAVSLRLPVLGACYAILSLYAFALYGIDKRRAVRGKRRIPEHRLLLPALFGGWTGAYLGSRMFRHKTAKKRFVVLFRLTVSGNVLATCILIDYFVPPELFVKLGQHL

SEQ ID NO: 2821 - DNA, 476 bp, Neisseria meningitidis
atgaagcggcaggctttcttcaaactgatggcgtgtgcggcatttctgtctgccgtttcgctgcgcctccccgtattgggcgcgtgttacgcaatattgtccctctatgcgtttgcactttacggcatcgacaaacggtgcgccatacgggggcaacgccgcattcccgaacaccgcctgctgctgcctgcattgctcggcggctgggtgggcgcgtatttcggcagcatgacattcaaacataagacagcgaaaaagcgttttgttgtgctgttccgtctgactgtttcaggtaatgtcttggcgaccctcatcctgatttatagtggattaaatttaaaccagtacggcgttgcctcgccttgccgtactatttgtactgtctgcggcttcgtcgccttgtcctgatttttgttaatccactatattattttgtcccgcctgaatttttcgtaaaactcgggcagaatacctga

SEQ ID NO: 2822 - protein, 157 aa, Neisseria meningitidis
  misc_feature (142)..(142): Xaa can be any naturally occurring amino acid
MKRQAFFKLMACAAFLSAVSLRLPVLGACYAILSLYAFALYGIDKRCAIRGQRRIPEHRLLLPALLGGWVGAYFGSMTFKHKTAKKRFVVLFRLTVSGNVLATLILIYSGLNLNQYGVASPCRTICTVCGFVALSFLLIHYXYFVPPEFFVKLGQNT

SEQ ID NO: 2823 - DNA, 526 bp, Neisseria meningitidis
atgaagcggcaggctttcttcaaactgatggcgtgtgcggcatttctgtctgccgtttcgctgcgcctccccgtattgggcgcgtgttacgcaatattgtccctctatgcgtttgcactttacggcatcgacaaacggcgtgccgtgcggggaaaacgccgcattcccgaacaccgcctgctgctgcctgccttgttcggcggttgggcgggcgcatacttgggcagcaggatattcaggcataaaacggcgaaaaagcgttttgttgtgctgttccgtctgactgtttcgggcaatgtcctggcgaccctcatcctgatttatagtggattaaatttaaaccagtacggcgttgcctcgccttagctcaaagagaacgattctctaaggtgctgaagcaccaagtgaatcggttccgtactatttgtactgtctgcggcttcgtcgccttgtcctgatttttgttaatccactatattattttgtcccgcctgaatttttcgtaaaactcgggcagaatacctga

SEQ ID NO: 2824 - protein, 174 aa, Neisseria gonorrhoeae
  misc_feature (122)..(122): Xaa can be any naturally occurring amino acid
  misc_feature (159)..(159): Xaa can be any naturally occurring amino acid
MKRQAFFKLMACAAFLSAVSLRLPVLGACYAILSLYAFALYGIDKRRAVRGKRRIPEHRLLLPALFGGWAGAYLGSRIFRHKTAKKRFVVLFRLTVSGNVLATLILIYSGLNLNQYGVASPXAQRERFSKVLKHQVNRFRTICTVCGFVALSFLLIHYXYFVPPEFFVKLGQNT

SEQ ID NO: 2825 - DNA, 516 bp, Neisseria gonorrhoeae
atgaaacaaatgcttttggccgtcggcgtgggcgcggtgttggcgggctgcggcaaggatgccggcggttacgagggttattggcgcgaaaagtcggacaaaaaagagggcgtgattgccgtcaaaaaaaaaggcaattacttccttaataaaatcaacgtgtttacaggcaaggaggagtctttgcttttgtctgaaaaagacggcgcgctttcgataaacacggggataggggaaatcccgatcaaactttccgacgacgggaaagagctgtatgtcgaacgcaggcggtatgtgaaaaccgatgcggcgatgaaggacaaaatcatcgcccaccagaaaaagtgcggacaaacggcacaggcatacctcgacgcgcgaaatgcgttgccgtcaaaccaaacgtatcagcagcgtcaggcggcgatcgagcaattgaaacggcggtttgaagccgagtttgacgaattggaaaaagaaatcaaatgcaacggcaaaccgacattgttgttttag

SEQ ID NO: 2826 - protein, 171 aa, Neisseria gonorrhoeae
MKQMLLAVGVGAVLAGCGKDAGGYEGYWREKSDKKEGVIAVKKKGNYFLNKINVFTGKEESLLLSEKDGALSINTGIGEIPIKLSDDGKELYVERRRYVKTDAAMKDKIIAHQKKCGQTAQAYLDARNALPSNQTYQQRQAAIEQLKRRFEAEFDELEKEIKCNGKPTLLF

SEQ ID NO: 2827 - DNA, 150 bp, Neisseria meningitidis
atgaaacaaatgcttttagccgtcggcgtggtggcggtgttggcgggctgcggcaaggatgccggcggttacgagggttattggcgcgaaaagtcggacaaaaaagagggtatgattgccgtcaaaaaagaaaaaggcaattacttcctt

SEQ ID NO: 2828 - protein, 50 aa, Neisseria meningitidis
MKQMLLAVGVVAVLAGCGKDAGGYEGYWREKSDKKEGMIAVKKEKGNYFL

SEQ ID NO: 2829 - DNA, 516 bp, Neisseria gonorrhoeae
atgaaacaaatgcttttggccgtcggcgtggcggcggtgttggcgggctgcggcaaggatgccggcggttacgagggttattggcgcgaaaagtcggacaaaaaagagggcgtgattgccgtcaaaaaaaaaggcaattacttccttaataaaatcaacgtgtttacaggcaaggaggagtctttgcttttgtctgaaaaagacggcgcgctttcgataaacacggggataggggaaatcccgatcaaactttccgacgacgggaaagagctgtatgtcgaacgcaggcggtatgtgaaaaccgatgcggcgatgaaggacaaaatcatcgcccaccagaaaaagtgcggacaaacggcacaggcatacctcgacgcgcgaaatgcgttgccgtcaaaccaaacgtatcagcagcgtcaggcggcgatcgagcaattgaaacggcggtttgaagccgagtttgacgaattggaaaaagaaatcaaatgcaacggcaaaccgacattgttgttttag

SEQ ID NO: 2830 - protein, 171 aa, Neisseria gonorrhoeae
MKQMLLAVGVAAVLAGCGKDAGGYEGYWREKSDKKEGVIAVKKKGNYFLNKINVFTGKEESLLLSEKDGALSINTGIGEIPIKLSDDGKELYVERRRYVKTDAAMKDKIIAHQKKCGQTAQAYLDARNALPSNQTYQQRQAAIEQLKRRFEAEFDELEKEIKCNGKPTLLF

SEQ ID NO: 2831 - DNA, 522 bp, Neisseria meningitidis
atgaaacaaatgcttttagccgtcggcgtggtggcggtgttggcgggctgcggcaaggatgccggcggttacgagggttattggcgcgaaaagtcggacaaaaaagagggtatgattgccgtcaaaaaagaaaaaggcaattacttccttaataaaatccacgtggttacaggcaaggaagagtccttgcttttgtctgaaaaagacggcgcgctttcgataaacacagggataggggaaatcccgatcaaactttccgacgacgggaaagagctgtatgtcgaacgtaggcagtatgtcaaaaccgatgcggcgatgaaggacaaaatcatcgcccatcagaaaaagtgcggacaaacagcacaggcataccgcgacgcgcgaaatgcgttgccgtcaaaccagacgtatcagcagcatctggcggcgatcgagcaattgaaacggcggtttgaagccgagtttgacgaattggaaaaagaaatcaaatgcaacggcagaagcccggcattgttgctttag

SEQ ID NO: 2832 - protein, 173 aa, Neisseria meningitidis
MKQMLLAVGVVAVLAGCGKDAGGYEGYWREKSDKKEGMIAVKKEKGNYFLNKIHVVTGKEESLLLSEKDGALSINTGIGEIPIKLSDDGKELYVERRQYVKTDAAMKDKIIAHQKKCGQTAQAYRDARNALPSNQTYQQHLAAIEQLKRRFEAEFDELEKEIKCNGRSPALLL

SEQ ID NO: 2833 - DNA, 369 bp, Neisseria meningitidis
aataaaatcaacgtgtttacaggtaaggaagaatctatgcttttgtctgaaaaagacggcgcgctttcgataaacacggggataggggaaatcccgatcaaactttccgacgacgggaaagagctgtatgtcgaacgcaggcagtatgtcaaaaccgatgcggcgatgaaggacaaaatcatcgcccatcagaaaaagtgcggacaaacggcacaggcatatctcgacgcgcgaaatgcgttgccgtcaaaccagacgtatcagcagcatcaggcggcgatcgagcagttgaaacggcggtttgaagccgagtttgacgaattggaaaaagaaatcaaatgcaacggcaaaccgacattgttgttttag

SEQ ID NO: 2834 - protein, 122 aa, Neisseria meningitidis
NKINVFTGKEESMLLSEKDGALSINTGIGEIPIKLSDDGKELYVERRQYVKTDAAMKDKIIAHQKKCGQTAQAYLDARNALPSNQTYQQHQAAIEQLKRRFEAEFDELEKEIKCNGKPTLLF

SEQ ID NO: 2835 - DNA, 489 bp, Neisseria gonorrhoeae
atgaaacacaccgtatccgcatcggtcatcctgcttttgaccgcttgcgcgcaattacctcaaaataacgaaaacctgtggcagccgtccgaacacatcagcagttttgcagcggaagggcggttggcagtcaaagcggaagggaaaggttcgtatgcaaatttcgattggacataccaaccgcccgtggaaaccatcaatatcaacacccctttgggcagtacgctcggacagttgtgtcaagacagggacggcgcattggcagtggacggcaaaggaaatgtctatcaggcagagggtacggaagacttgagcaggcagctggtcggtttcaaactgccaatccaatatctgcatatctgggcggaaggcaggcgtgtggcgggcgcgccttaccgcatccgttcagacggcatattggaacaatacggttggacaatcgggcagaactgccgacagtggggggcaagtccgaacgttgcaactgaa

SEQ ID NO: 2836 - protein, 163 aa, Neisseria gonorrhoeae
MKHTVSASVILLLTACAQLPQNNENLWQPSEHISSFAAEGRLAVKAEGKGSYANFDWTYQPPVETININTPLGSTLGQLCQDRDGALAVDGKGNVYQAEGTEDLSRQLVGFKLPIQYLHIWAEGRRVAGAPYRIRSDGILEQYGWTIGQNCRQWGASPNVATE

SEQ ID NO: 2837 - DNA, 582 bp, Neisseria meningitidis
atgaaacacaccgtatccgcatcggtcatcctgcttttgaccgcttgcgcgcaattacctcaaaataacgaaaacctgtggcagccgtccgaacacatcagcagttttgcagcagaagggcggttggcagtgaaagcggaagggaaaggttcgtatgcaaatttcgattggacataccaaccgcccgtggaaaccatcaatatcaatacccctttgggcagtacgctcgggcagttgtgtcaagacagggacggcgcattggcagtggacggcaaaggaaatgtctatcaggcggaaagtgcggaagaattgagcaggcagctggtcggtttcaaactgccaatccaatatctgcatatctgggcagatggcaggcgtgtggcgggcgcgccttaccgcatcctgccggacggcatattggaacaatacggttggactgtcggcagaaccgccgacagtggggggcaagtccgaacgttgcaactgaataacggaaatttgaacatcaggctggttttcaccgaaatcggtatgccgtctgaaaccgaaaccccggaacgctgtgcggcgcgcacgagataa

SEQ ID NO: 2838 - protein, 193 aa, Neisseria meningitidis
MKHTVSASVILLLTACAQLPQNNENLWQPSEHISSFAAEGRLAVKAEGKGSYANFDWTYQPPVETININTPLGSTLGQLCQDRDGALAVDGKGNVYQAESAEELSRQLVGFKLPIQYLHIWADGRRVAGAPYRILPDGILEQYGWTVGRTADSGGQVRTLQLNNGNLNIRLVFTEIGMPSETETPERCAARTR

SEQ ID NO: 2839 - DNA, 724 bp, Neisseria gonorrhoeae
atgaaaacctacgcacaggcactctataccgcagccctgctcaccgcctgcagccccgcagccgattcaaaccatccgtccggacaaaatgccccggccaataccgaatccgacggaaaaaacattaccctgctcaatgcctcgtacgatgtgacacggtatttttacaaagaatacgaccacttgtttgtcggaacataccaatccgaacaccccggcacatccgtcagcatccaacaatcccacggcggcttcagcaaacaggcattatccgtagccaacggccttcaagccgatgtcgtaaccatgaaccaatcttccgacatcgacctgctcgaaaaaaaggactggtagaaaaaggctggcaacaagccctccccgatcacgccgcaccctacaccagcactatggttttccttgtccgaaaaaacaaccccaaacagatccgcgattggaacgaccttgccaaagacggcgttaacatcgtcatcgccaagacctcgggcaacggacgctacgccttcctcggcgcatacggttacggtctgaaagccaacaacggcaacgagcaggaagcccaaaaactcgtcgcatccatcctcaaaaacacacccgtttttgaaaacggcggacgcgcccgccgccaccaccttcacacaacgcaacatcggcgacgtactcatcacttttgaaaacgaagccaactacgtcagcaaaaaactga

SEQ ID NO: 2840 - protein, 241 aa, Neisseria gonorrhoeae
  misc_feature (115)..(115): Xaa can be any naturally occurring amino acid
  misc_feature (213)..(213): Xaa can be any naturally occurring amino acid
MKTYAQALYTAALLTACSPAADSNHPSGQNAPANTESDGKNITLLNASYDVTRYFYKEYDHLFVGTYQSEHPGTSVSIQQSHGGFSKQALSVANGLQADVVTMNQSSDIDLLEKXGLVEKGWQQALPDHAAPYTSTMVFLVRKNNPKQIRDWNDLAKDGVNIVIAKTSGNGRYAFLGAYGYGLKANNGNEQEAQKLVASILKNTPVFENGGRXPPPPPSHNATSATYSSLLKTKPTTSAKN

SEQ ID NO: 2841 - DNA, 729 bp, Neisseria meningitidis
atgaaaacctacgcaccggcactctataccgcagccctgctcaccgcctgcagccccgcagccgattcaaaccatccgtccggacaaaatgccccggccaataccgaatccgacggaaaaaacattaccctgctcaacgcctcatacgatgtggcacgggatttttacaaagaatacaaccccttatttatcaaaacataccaatccgaacaccccggcacatccgtcagcatccaacagtcccacggcggctccagcaaacaggcattatccgtagccaacggccttcaagccgatgtcgtaaccatgaaccaatcctccgacatcgacctgctcgaaaaaaaaggactggtagaaaaaggctggcaacaagccctccccgaccacgccgcgccctacaccagcactatggttttccttgtccgaaaaaacaaccccaaacagatccgcgattggaacgaccttgccaaagacggcgttaacatcgtcatcgccaatcccaaaacctcgggcaacggacgctacgccttcctcggcgcatacggttacggtctgaaaaccaccaacggcaacgaacaggaagcccaaaaactcgtcgcatccatcctcaaaaacacccccgtttttgaaaacggcggacgckcgccaccaccaccttcacacaacgcaacatcggcgacgtactcatcacttttgaaaacgaagccaactacgtcagcraaaaactga

SEQ ID NO: 2842 - protein, 242 aa, Neisseria meningitidis
  misc_feature (215)..(215): Xaa can be any naturally occurring amino acid
MKTYAPALYTAALLTACSPAADSNHPSGQNAPANTESDGKNITLLNASYDVARDFYKEYNPLFIKTYQSEHPGTSVSIQQSHGGSSKQALSVANGLQADVVTMNQSSDIDLLEKKGLVEKGWQQALPDHAAPYTSTMVFLVRKNNPKQIRDWNDLAKDGVNIVIANPKTSGNGRYAFLGAYGYGLKTTNGNEQEAQKLVASILKNTPVFENGGRXPPPPSHNATSATYSSLLKTKPTTSAKN

SEQ ID NO: 2843 - DNA, 729 bp, Neisseria meningitidis
atgaaaacctacgcaccggcactctataccgcagccctgctcagcgcctgcagccccgcagccgattcaaaccatccgtccggacaaaatgccccggccaataccgaatccgacggaaaaaacattaccctgctcaacgcctcatacgatgtggcacgggatttttacaaagaatacaaccccttatttatcaaaacataccaatccgaacaccccggcacatccgtcagcatccaacagtcccacggcggctccagcaaacaggcattatccgtagccaacggccttcaagccgatgtcgtaaccatgaaccaatcctccgacatcgacctgctcgaaaaaaaaggactggtagaaaaaggctggcaacaagccctccccgaccacgccgcgccctacaccagcactatggttttccttgtccgaaaaaacaaccccaaacagatccgcgattggaacgaccttgccaaagacggcgttaacatcgtcatcgccaatcccaaaacctcgggcaacggacgctacgccttcctcggcgcatacggttacggtctgaaaaccaccaacggcaacgaacaggaagcccaaaaactcgtcgcatccatcctcaaaaacacccccgtttttgaaaacggcggacgcgcgccaccaccaccttcacacaacgcaacatcggcgacgtactcatcacttttgaaaacgaagccaactacgtcagcaaaaaactga

SEQ ID NO: 2844 - protein, 242 aa, Neisseria meningitidis
MKTYAPALYTAALLSACSPAADSNHPSGQNAPANTESDGKNITLLNASYDVARDFYKEYNPLFIKTYQSEHPGTSVSIQQSHGGSSKQALSVANGLQADVVTMNQSSDIDLLEKKGLVEKGWQQALPDHAAPYTSTMVFLVRKNNPKQIRDWNDLAKDGVNIVIANPKTSGNGRYAFLGAYGYGLKTTNGNEQEAQKLVASILKNTPVFENGGRAPPPPSHNATSATYSSLLKTKPTTSAKN

SEQ ID NO: 2845 - DNA, 1464 bp, Neisseria gonorrhoeae
atgaaattgggtttcaaaccgatacccctcgccattgccgcagtattgtgcgccctggttttggcactgcccgtacccgacggggtcaagcctcaggcttggacgctgctggctatgtttgtcggtgtgattgccgccattatcggcaaggttatgccgttgggcgcgctgtcgattattgccgtcgggttggtcgcagtaaccggcgtaaccgccgacaaaccgggcgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaattatcattccaatcccatttcgtcggctatggctattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatattttttgtatccgcctgaaattaaagaaacgcccaatgctgttcaatttgccaaagaccgtctgagcgagatgggtaaaatgtcggcagacgaaatcattatggcggtcattttcggtatcttgctgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttctcgctgctgccgtttcactgaatgccccggcgatgccgactgcgctgatgatggcggccgcatccaacattatgatgaccctcactcattatgcgaccggtacttcacctgtgattttcggctcgggctacaccacaatgggagaatggtggaaggcgggttttatcatgagcgtagtcaattttctgattttttccgttatcggcagcatttggtggaaagttctgggatattggtaa

SEQ ID NO: 2846 - protein, 487 aa, Neisseria gonorrhoeae
MKLGFKPIPLAIAAVLCALVLALPVPDGVKPQAWTLLAMFVGVIAAIIGKVMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMAITATAPNPLIVNLIAENLGSSFRLSWGAWAWAMAVPGVIAFFVMPLILYFLYPPEIKETPNAVQFAKDRLSEMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFLAAAVSLNAPAMPTALMMAAASNIMMTLTHYATGTSPVIFGSGYTTMGEWWKAGFIMSVVNFLIFSVIGSIWWKVLGYW

SEQ ID NO: 2847 - DNA, 1464 bp, Neisseria meningitidis
atgaaattgggtttcaaaccgatacccctcgccattgccgcagtattgtgcgccctggttttggcactgcccgtacccgacggggtcaagcctcaggcttggacgctgctggccatgtttgtcggtgtgattgccgccattatcggcaaggccatgccgttgggcgcgctgtcgattattgccgtcgggttggtcgcagtaaccggcgtaaccgccgacaaaccgggcgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaactatcattccaatcccatttcgtcggctatgtttattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatatttwytgtatccgcctgaaattaaagaaacgcccaatgccgttcaatttgccaaagaccgtctgagggagatgggtaaaatgtcggcagacgaaatcattatggcggtcattttcggtatcttgctgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttttcgctgctgccgtttcactgaatgccccggcgatgccgaccgcgctgatgatggcggccgcatccaacattatgatgaccctcactcattatgcgaccggtacttcgcctgtgattttcggttcgggctacaccacaatgggagaatggtggaaggcgggttttatcatgagcgtagtcaattttctgatttttttcgttatcggcagcatttggtggaaagttctggggtattggtaa

SEQ ID NO: 2848 - protein, 487 aa, Neisseria meningitidis
  misc_feature (246)..(246): Xaa can be any naturally occurring amino acid
MKLGFKPIPLAIAAVLCALVLALPVPDGVKPQAWTLLAMFVGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYXLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 2849 - DNA, 1464 bp, Neisseria meningitidis
atgaaattgggtttcaaaccgatacccctcgccattgccgcagtattgtgcgccttggttttggcactgcccgtacccgacggggtcaagcctcaggcttggacgctgctggccatgtttatcggtgtgattgccgccattatcggcaaggccatgccgttgggtgcgctgtcgattattgccgtcgggttggtcgcagtaaccggcgtaaccgccgacaaaccgggtgcggcgatgagcgatgcgttgagtgcgttcgccaatccgttgatttggctgattgccatcgcagttatgatttcgcgcggtttgctcaaaacagggctggggatgcgtatcggatatttgtttatcgccgtttttggaagaaaaacgctgggcatcggttacagtctcgctctttccgaactgctgctggctcccgttaccccttccaataccgcgcgcggcggcggcattatacatccgattatgcagtcgattgccggcagttacggctccaatcccgcaaaaggcacagaaggcaagatgggtaaatatttggctttggtcaactatcattccaatcccatttcgtcggctatgtttattactgcaactgcccccaaccctttaatcgtcaacttgattgccgaaaatttaggcagtagtttccgtctttcttggggggcgtgggcgtgggcaatggctgttcccggcgttatcgcctttttcgttatgcctttgattttatattttttgtatccgcctgaaattaaagaaacgcccaatgccgttcaatttgccaaagaccgtctgagggagatgggtaaaatgtcggcagacgaaatcattatggcggtcattttcggtatcttgttgctgttgtgggcagatgttcccgcccttattaccggcaatcacgcttttagtatcaacgccaccgccaccgcatttatcggattaagcctgcttttgctttccggtgtattgacttgggacgatgttttgaaagaaaaaagcgcgtgggatacgattatttggtttggcgcattgattatgatggccgcatttttaaataaactcggactgattaaatggttctccggagtgttggcggaaagtgtcggcggtttgggcgttagcggcacggctgcgggcgtaatcctcgtgcttgcttatatgtatgcgcattatatgtttgccagtactactgcacatattaccgctatgttcggcgcatttttcgctgctgccgtttcactgaatgccccggcgatgccgaccgcgctgatgatggcggccgcatctaacattatgatgaccctcactcattatgcgaccggtacttcgcctgtgattttcggttcgggctacaccacaatgggagaatggtggaaggcgggttttatcatgagcgtagtcaattttctgatttttttcgttatcggcagcatttggtggaaagttctggggtattggtaa

SEQ ID NO: 2850 - protein, 487 aa, Neisseria meningitidis
MKLGFKPIPLAIAAVLCALVLALPVPDGVKPQAWTLLAMFIGVIAAIIGKAMPLGALSIIAVGLVAVTGVTADKPGAAMSDALSAFANPLIWLIAIAVMISRGLLKTGLGMRIGYLFIAVFGRKTLGIGYSLALSELLLAPVTPSNTARGGGIIHPIMQSIAGSYGSNPAKGTEGKMGKYLALVNYHSNPISSAMFITATAPNPLIVNLIAENLGSSFRLSWGAWAWAMAVPGVIAFFVMPLILYFLYPPEIKETPNAVQFAKDRLREMGKMSADEIIMAVIFGILLLLWADVPALITGNHAFSINATATAFIGLSLLLLSGVLTWDDVLKEKSAWDTIIWFGALIMMAAFLNKLGLIKWFSGVLAESVGGLGVSGTAAGVILVLAYMYAHYMFASTTAHITAMFGAFFAAAVSLNAPAMPTALMMAAASNIMMTLTHYATGTSPVIFGSGYTTMGEWWKAGFIMSVVNFLIFFVIGSIWWKVLGYW

SEQ ID NO: 2851 - DNA, 483 bp, Neisseria meningitidis
atgaaacttcctttatcctatttgcctaatattcgctttttgtcttggtgctgcttattggcaggtatcattgctcctgctactttgttggcctcccccaaccctgccgaaatccgtatgcagcaagatattcagcaacgccaacgcgaagagcagttgcgccaaaccatgcagcctgaaagcgatgtgcgtttgcatcaaaaaaacacgggggaaacggttaatcagttgatgggcgatgacagcagccaaccgtgttttgccattaacgaatgggtgttggaaggcgaacaccatgctcggtttcagtttgccctaaaacgtgccttgcgcgaaacgggttttcaggctggcaagtgtctgcatgcgggcaacattaatcaaatcatgtccttagcacaaaatgctttgatcggcaggggatataccacgacccgtatcttggctgcgccacaggatttgaatagtggaagcttcaattaa

SEQ ID NO: 2852 - protein, 160 aa, Neisseria meningitidis
MKLPLSYLPNIRFLSWCCLLAGIIAPATLLASPNPAEIRMQQDIQQRQREEQLRQTMQPESDVRLHQKNTGETVNQLMGDDSSQPCFAINEWVLEGEHHARFQFALKRALRETGFQAGKCLHAGNINQIMSLAQNALIGRGYTTTRILAAPQDLNSGSFN

SEQ ID NO: 2853 - DNA, 1437 bp, Neisseria gonorrhoeae
ggcaagtgtctgcatgcgggcgacattaatcaaatcatgtccttagcacaaaatgctttgatcggcaggggatataccacgacccgtatcttggctgcgccacaggatttgaatagtggcaagcttcaattaaccctgatgccgggctatctgcgctccatacgaatcgatcggtccaacgatgatcaaacccatgcaggacgtattgcagcattccaaaacaaatttcccacccgctcgaacgatctgttgaatctgcgtgatttggaacaaggactggaaaatctcaaatgtctcccgactgcggaagccgatctccaaatcgttcccgtagagagagaaccaaaccaaagtgatgtcgtggtgcaatggcggtaacgtctgctgccctactgtgtgagtgtggggatggataattcgggtagtgaggcgacaggaaaataccaaggaaatatcactttctctgccgacaatccttttggactgagtgatatgttctatgtaaattatggacgttcaattggcggtacgcccgatgaggaaaattttgacggccatcgcaaagaaggcggatcaaacaattacgccgtacattattcagcccctttcggtaaatggacatgggcattcaatcacaatggctaccgttaccatcaggcggtttccggattatcggaagtctatgactataatggaaaaagttacaacactgatttcggcttcaaccgcctgttgtatcgtgatgccaaacgcaaaacctatctcagtgtaaaactgtggacgagggaaacaaaaagttacattgatgatgccgaactgactgtacaacggcgtaaaaccacaggttggttggcagaactttcccacaaaggatatatcggtcgcagtacggcagattttaagttgaaatataaacacggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgcctgccgagcggggatggtattggcgcaacgatttgagctggcaatttaaaccaggccatcagctttatcttggggctgatgtaggacatgtttcaggacaatccgccaaatggttatcgggccaaactctagccggcacagcaattgggatacgcgggcagataaagcttggcggcaacctgcattacgatatatttaccggccgtgcattgaaaaagcccgaatattttcagacgaagaaatgggtaacggggtttcaggtgggttattcgttttga

SEQ ID NO: 2854 - protein, 477 aa, Neisseria gonorrhoeae
GKCLHAGDINQIMSLAQNALIGRGYTTTRILAAPQDLNSGKLQLTLMPGYLRSIRIDRSNDDQTHAGRIAAFQNKFPTRSNDLLNLRDLEQGLENLKCLPTAEADLQIVPVEREPNQSDVVVQWRRLLPYCVSVGMDNSGSEATGKYQGNITFSADNPFGLSDMFYVNYGRSIGGTPDEENFDGHRKEGGSNNYAVHYSAPFGKWTWAFNHNGYRYHQAVSGLSEVYDYNGKSYNTDFGFNRLLYRDAKRKTYLSVKLWTRETKSYIDDAELTVQRRKTTGWLAELSHKGYIGRSTADFKLKYKHGTGMKDALRAPEEAFGEGTSRMKIWTASADVNTPFQIGKQLFAYDTSVHAQWNKTPLTSQDKLAIGGHHTVRGFDGEMSLPAERGWYWRNDLSWQFKPGHQLYLGADVGHVSGQSAKWLSGQTLAGTAIGIRGQIKLGGNLHYDIFTGRALKKPEYFQTKKWVTGFQVGYSF

SEQ ID NO: 2855 - DNA, 1788 bp, Neisseria meningitidis
atgaaacttcctttatcctatttgcctaatattcgctttttgtcttggtgctgcttattggcaggtatcattgctcctgctactttgttggcctcccccaaccctgccgaaatccgtatgcagcaagatattcagcaacgccaacgcgaagagcagttgcgccaaaccatgcagcctgaaagcgatgtgcgtttgcatcaaaaaaacacgggggaaacggttaatcagttgatgggcgatgacagcagccaaccgtgttttgccattaacgaagtggtgttggaaggcgaacaccatgctcggtttcagtttgccctaaaacgtgccttgcgcgaaacgggttttcaggctggcaagtgtctgcatgcgggcaacattaatcaaatcatgtccttagcacaaaatgctttgatcggcaggggatataccacgacccgtatcttggctgcgccacaggatttgaatagtggcaagcttcaattaaccctgataccgagctatctgcgctccatacgaatcgatcggtctaacgatgatcaaacccatgcaggacgtattgcagcattccagaacaaatttcccacccgctcgaacgatctgttgaatctgcgtgatttggaacaaggactggaaaatctcaaacgtctcccgactgcggaagccgatctccaaatcgttcccgtagagggagaaccaaaccaaagtgatgtcgtggtgcaatggcggcaacgtctgctgccctaccgtgtgagtgtggggatggataattcgggtagtgaggcgacaggaaaataccaaggaaatatcactttctctgccgacaatcctttgggactgagtgatatgttctatgtaaattatggacgttcgattggcggtacgcccgatgaggaaagttttgacggccatcgcaaagaaggcggatcaaacaattacgccgtacattattcagcccctttcggtaaatggacatgggcattcaatcacaatggctaccgttaccatcaggcagtttccggattatcggaagtctatgactataatggaaaaagttacaatactgatttcggcttcaaccgcctgttgtatcgtgatgccaaacgcaaaacctatctcggtgtaaaactgtggatgagggaaacaaaaagttacattgatgatgccgaactgactgtacaacggcgtaaaactgcgggttggttggcagaactttcccacaaagaatatatcggtcgcagtacggcagattttaagttgaaatataaacgcggcaccggcatgaaagatgctctgcgcgcgcctgaagaagcctttggcgaaggcacgtcacgtatgaaaatttggacggcatcggctgatgtaaatactccttttcaaatcggtaaacagctatttgcctatgacacatccgttcatgcacaatggaacaaaaccccgctaacatcgcaagacaaactggctatcggcggacaccacaccgtacgtggcttcgacggtgaaatgagtttgtctgccgagcggggatggtattggcgcaacgatttgagctggcaatttaaaccaggccatcagctttatcttggggctgatgtaggacatgtttcaggacaatccgccaaatggttatcgggccaaactctagtcggcacagcaattgggatacgcgggcagataaagcttggcggcaacctgcattacgatatatttaccggccgcgcattgaaaaagcccgaatttttccaatcaaggaaatgggcaagcggttttcaggtaggctatacgttttaa

SEQ ID NO: 2856 - protein, 595 aa, Neisseria meningitidis
MKLPLSYLPNIRFLSWCCLLAGIIAPATLLASPNPAEIRMQQDIQQRQREEQLRQTMQPESDVRLHQKNTGETVNQLMGDDSSQPCFAINEVVLEGEHHARFQFALKRALRETGFQAGKCLHAGNINQIMSLAQNALIGRGYTTTRILAAPQDLNSGKLQLTLIPSYLRSIRIDRSNDDQTHAGRIAAFQNKFPTRSNDLLNLRDLEQGLENLKRLPTAEADLQIVPVEGEPNQSDVVVQWRQRLLPYRVSVGMDNSGSEATGKYQGNITFSADNPLGLSDMFYVNYGRSIGGTPDEESFDGHRKEGGSNNYAVHYSAPFGKWTWAFNHNGYRYHQAVSGLSEVYDYNGKSYNTDFGFNRLLYRDAKRKTYLGVKLWMRETKSYIDDAELTVQRRKTAGWLAELSHKEYIGRSTADFKLKYKRGTGMKDALRAPEEAFGEGTSRMKIWTASADVNTPFQIGKQLFAYDTSVHAQWNKTPLTSQDKLAIGGHHTVRGFDGEMSLSAERGWYWRNDLSWQFKPGHQLYLGADVGHVSGQSAKWLSGQTLVGTAIGIRGQIKLGGNLHYDIFTGRALKKPEFFQSRKWASGFQVGYTF

SEQ ID NO: 2857 - DNA, 612 bp, Neisseria gonorrhoeae
atgaaacccaaattcaaaaccgttttaaccgcgctgcttttggcggtttccctgccgtctatggcggcaacccgcgtcctgatggaaaccgatatgggcaatatccgtttggttttggacgaatccaaagcctccaaaaccgttgccaatttcgtgcgctatgcccgaaaaggcttttacgacaacacgattttccaccgcgtcatcggcggcttcgtcatccaaggcgacggattgaccgaggacttggtgcaaaaggcaaccgataaggccgttgccaacgaatccggcaacggcttgaaaaacaccgtcggcaccatcgcaatggcgcggacggcagcccccgattccgccgccgcccaattctttatcaatctggcggacaacggttcgctcgactacaaaaacggacaatacggctacaccgttttcggcagggtagaaagcggaatggacaccgtttccaaaatcgcccgcgtcaaaaccgccacgcgcggcttttatcaaaacgtacccgtacagcccgtcaaaatccgtcgcgttgttgtcgggcagtaacacgcagacagacgttcagacggcgtcgcccgtttcccaaaaaacgccgtttaa

SEQ ID NO: 2858 - protein, 185 aa, Neisseria gonorrhoeae
MKPKFKTVLTALLLAVSLPSMAATRVLMETDMGNIRLVLDESKASKTVANFVRYARKGFYDNTIFHRVIGGFVIQGDGLTEDLVQKATDKAVANESGNGLKNTVGTIAMARTAAPDSAAAQFFINLADNGSLDYKNGQYGYTVFGRVESGMDTVSKIARVKTATRGFYQNVPVQPVKIRRVVVGQ

SEQ ID NO: 2859 - DNA, 557 bp, Neisseria meningitidis
atgaaacccaaattcaaaaccgttttaaccgcgctgcttttggcggtttccctgccgtctatggcggcaacccatgttttgatggaaaccgatatgggcaatatccgtttggttttggacgaatccaaagcccccaaaaccgttgctaatttcgtgcgctatgcccgaaaaggcttttacgacgacaccgtttttcaccgcgttatcgacggttttgttatccagggcggtggattgaccgaggacttggcacaaaaggcaagcgataaggccgttgccaacgaatccggcaacggcttgaaaaacaccgccggcaccatcgccatggcgcggacgacagcccccgattccgccaccagccaattctttatcaatctggcggaccakcttcgctcgactacaaaaacggacaatacggctataccgttttcggcagggtcgaaagcggcatgaacaccgtttccaaaatcgcccgcgtcaaaaccgccacgcgcggcttttatcaaaacgtacccgtacagcccgtcaaaatccgtcgcgttgttgtcgggcagtaa

SEQ ID NO: 2860 - protein, 185 aa, Neisseria meningitidis
  misc_feature (129)..(130): Xaa can be any naturally occurring amino acid
MKPKFKTVLTALLLAVSLPSMAATHVLMETDMGNIRLVLDESKAPKTVANFVRYARKGFYDDTVFHRVIDGFVIQGGGLTEDLAQKASDKAVANESGNGLKNTAGTIAMARTTAPDSATSQFFINLADXXSLDYKNGQYGYTVFGRVESGMNTVSKIARVKTATRGFYQNVPVQPVKIRRVVVGQ

SEQ ID NO: 2861 - DNA, 558 bp, Neisseria meningitidis
atgaaacccaaattcaaaaccgttttaaccgcgctgcttttggcggtttccctgccgtctatggcggcaacccatgttttgatggaaaccgatatgggcaatatccgtttggttttggacgaatccaaagcacccaaaaccgttgccaatttcgtgcgctatgcccgaaaaggcttttacgacaatacgatttttcaccgcgtcatcggcggcttcgttatccaaggcggcggattgaccgaggacttggcacaaaaggcaagcgataaggccgttgccaacgaatccggcaacggcttgaaaaacactgtcggcaccatcgccatggcgcggacggccgatccggattccgccaccagccaattctttatcaatctggtggacaatgattcgctcaactacaaaaacggacaatacggctataccgttttcggcagggtcgaaagcggcatgaacaccgtttccaaaatcgcccgcgtcaaaaccgccacgcgcggcttttatcaaaacgtacccgtacagcccgtcaaaatccgtcgcgttgttgtcgggcagtaa

SEQ ID NO: 2862 - protein, 185 aa, Neisseria meningitidis
MKPKFKTVLTALLLAVSLPSMAATHVLMETDMGNIRLVLDESKAPKTVANFVRYARKGFYDNTIFHRVIGGFVIQGGGLTEDLAQKASDKAVANESGNGLKNTVGTIAMARTADPDSATSQFFINLVDNDSLNYKNGQYGYTVFGRVESGMNTVSKIARVKTATRGFYQNVPVQPVKIRRVVVGQ

SEQ ID NO: 2863 - DNA, 339 bp, Neisseria meningitidis; identical to SEQ ID NO: 2727

SEQ ID NO: 2864 - protein, 112 aa, Neisseria meningitidis; identical to SEQ ID NO: 2728

SEQ ID NO: 2865 - DNA, 689 bp, Neisseria gonorrhoeae
atgaaaaaaatcatcgcctccgcgcttatcgcaacattcgcactcaccgcctgccaagacgacacgcaggcgcggctcgaacggcagcagaaacagattgaagccctgcaacagcagctcgcacagcaggcagacgatacggtttaccaactgactcccgaagcagtcaaagacaccattcctgcccaggcgcaggcaaacggcaacaacggtcagcccgttaccggcaaagacgggcagcagtatatttacgaccaatcgacaggaagctggctgctgcaaagcctgattggcgcggcggcaggcgcgtttatcggcaacgcgctggcaaacaaattcacacgggcgggcaaccaagacagccccgtcgcccgtcgcgcgcgtgctgcctaccatcagtccgcacgccccaatgcgcgcaccagcagggatttgaacacgcgcagcctccgtgcaaaacaacaggcggcgcaggcgcagcgttaccgcccgacaacgcgcccgcccgtcaattaccgccatcgcgctatgcgcggtttcggcagaaggcggtaaacccggcgcgtcaatgccgtctgaagggctttcagacggcatttttgtatttgttaggggcattgttatgttgccgtttgattttcagacggcattttgtttccaagcgtttgatgtcgggatggcaattctga

SEQ ID NO: 2866 - protein, 229 aa, Neisseria gonorrhoeae
MKKIIASALIATFALTACQDDTQARLERQQKQIEALQQQLAQQADDTVYQLTPEAVKDTIPAQAQANGNNGQPVTGKRRAAVYLRPIDRKLAAAKPDWRGGRRVYRQRAGKQIHTGGQPRQPRRPSRACCLPSVRTPQCAHQQGFEHAQPPCKTTGGAGAALPPDNAPARQLPPSRYARFRQKAVNPARQCRLKGFQTAFLYLLGALLCCRLIFRRHFVSKRLMSGWQF

SEQ ID NO: 2867 - DNA, 617 bp, Neisseria meningitidis
  misc_feature (528)..(528): n is a, c, g, or t
cggctcgaacagcagcagaaacagattgaagccctgcaacagcagctcgcacagcaggcagacgatacggtttaccaactgactcccgaagcagtcaaagacaccattcctgccgaagcacaggcaaacggcaacaacgggcaacccgttaccggtaaagacgggcagcagtatatttacgaccaatcgacaggaagctggctgctgcaaagcctggtcggcgcggcggcaggcgcgtttatcggcaacgcgctggcaaacaaattcacacgggcaggcaaccaagacagtcccgtcgcccggcgcgcgcgtgcagcctaccatcagtccgcacgccccaatgcgcgcaycagcagggatttgaacacgcgcagcctccgtgcaaaacaacaggcggcgcakgcgcagcgttaccgcccgacaacgcgcccgsccgscaattaccgccgccccgctatgcgcggtttcggcaggaggcggtaaacccggcgcgccaatgccgtctgaagagctttcagacggcatttntgcatttgttagggacattgttatgttgccgtttgattttcagacggcattttgtttccaagcgtttgatgtcgggatggcaattctga

SEQ ID NO: 2868 - protein, 205 aa, Neisseria meningitidis
  misc_feature (53)..(53): Xaa can be any naturally occurring amino acid
  misc_feature (135)..(135): Xaa can be any naturally occurring amino acid
  misc_feature (145)..(145): Xaa can be any naturally occurring amino acid
  misc_feature (177)..(177): Xaa can be any naturally occurring amino acid
RLEQQQKQIEALQQQLAQQADDTVYQLTPEAVKDTIPAEAQANGNNGQPVTGXRRAAVYLRPIDRKLAAAKPGRRGGRRVYRQRAGKQIHTGRQPRQSRRPARACSLPSVRTPQCAHQQGFEHAQPPCKTTGGAXAALPPDNAPXRQLPPPRYARFRQEAVNPARQCRLKSFQTAFXHLLGTLLCCRLIFRRHFVSKRLMSGWQF

SEQ ID NO: 2869 - DNA, 689 bp, Neisseria meningitidis
atgaaaaaaatcatcgcctccgcgcttatcgcaacattcgcactcgccgcctgccaagacgacgcgcaggcgcggctcgaacagcagcagaaacagattgaagccctgcaacagcagctcgcacagcaggcagacgatacggtttaccaactgactcccgaagcagtcaaagacaccattcctgccgaagcacaggcaaacggcaacaacgggcaacccgttaccggtaaagacgggcagcagtatatttacgaccaatcgacaggaagctggctgctgcaaagcctggtcggcgcggcggcaggcgcgtttatcggcaacgcgctggcaaacaaattcacacgggcaggcaaccaagacagtcccgtcgcccggcgcgcgcgtgccgcctaccatcagtccgcacatcccaatgcgcgcaccagcagggatttgaacacgcgcagcctccgtgcaaaacaacaggcggcgcaggcgcagcgttaccgcccgacaacgcgcccgcccgccaattaccgccgccccgccatgcgcggtttcggcagaaggcggtaaatccggcgtgccaatgccgtctgaagggctttcagacggcatttttgtatttgttagggacattgttatgttgccgtttgatttttagacggcattttgtttccaagagtttgatgtcgggatggcaattctga

SEQ ID NO: 2870 - protein, 228 aa, Neisseria meningitidis
  misc_feature (76)..(76): Xaa can be any naturally occurring amino acid
MKKIIASALIATFALAACQDDAQARLEQQQKQIEALQQQLAQQADDTVYQLTPEAVKDTIPAEAQANGNNGQPVTXRRAAVYLRPIDRKLAAAKPGRRGGRRVYRQRAGKQIHTGRQPRQSRRPARACRLPSVRTSQCAHQQGFEHAQPPCKTTGGAGAALPPDNAPARQLPPPRHARFRQKAVNPACQCRLKGFQTAFLYLLGTLLCCRLIFRRHFVSKSLMSGWQF

SEQ ID NO: 2871 - DNA, 1518 bp, Neisseria meningitidis
atgttgtatttcagatacggctttttggttgtttggtgtgcggcaggtgtttctgccgcctatggggcggatgcgcccgcgattttggatgacaaggcattgttgcaggtgcagcggtcggtgtcggataagtgggcggaatcagattggaaagttgaaaatgatgccccgcgcgtggttgacggggattttttgttggcgcatccgaaaatgttggaacatagtttgcgcgacgcgctcaacggcaatcaggcggatttaatcgcttcgttggcggatttgtatgccaagctgccggattatgacgcggttttgtacggcagggcgcgggctttgctggcgaaattggcgggaaggccggcggaggcggtggcgcggtatcgggaactgcacggggaaaatgcggcagacgagcggattttgctggatttggcggcggcggagtttgacgatttccggctgaagtcggcagaaaggcattttgcggaggcggcaaaattggatttgccggcaccggttttggaaaatgtggggcgttttcggaaaaaaacggaggggctgacgggctggcgtttttcgggcggcatcagtccggcggtcaatagaaatgccaataatgccgcgccgcaatattgccggcaaaacggaggccggcagatatgcagtgtcagccgggcggagcgggcggcagggttgaattatgaaatcgaggcggaaaagctgacgccgttggcagataatcattatttgttgttccgttccaatatcggcggcacgagctattatttcagtaaaaaatcagcttatgatgacgggttcggcagggcgtatttgggttggcagtataaaaatgcacggcagacggcggggattttgccgttttatcaggtgcagttgtcgggcagcgacggctttgatgcgaaaacaaaacgggtaaacaaccgccgcctgccgccgtatatgctggcgcacggagtcggcgtgcagctgtcccatacttaccgcccaaacccgggatggcaattttcggtcgcgctggaacattaccgccaacgctaccgcgaacaggatagggcggaatacaataacggcaggcaggacgggttttatgtttcgtcggcaaaacgtttgggcgaatcggcaactgtgttcggcggctggcagtttgtgcggtttgtgccgaaacgcgaaacggtgggcggcgcggtcaataatgccgcctaccggcgcaacggtgtttatgccggttgggcgcaggagtggcggcagttgggcggtttgaacagtcgggtttccgcgtcttatgcccgccgcaactataagggcattgcggctttctcgacagaggcgcaacgcaaccgcgaatggaatgtctcgctggctttgagccacgacaagttgtcgtacaaaggtatcgtgccggcgttgaattatcgtttcggcaggacggaaagtaatgtgccgtatgcgaaacgccgcaacagcgaggtgtttgtgtcggcggattggcggttttga

SEQ ID NO: 2872 - protein, 505 aa, Neisseria meningitidis
MLYFRYGFLVVWCAAGVSAAYGADAPAILDDKALLQVQRSVSDKWAESDWKVENDAPRVVDGDFLLAHPKMLEHSLRDALNGNQADLIASLADLYAKLPDYDAVLYGRARALLAKLAGRPAEAVARYRELHGENAADERILLDLAAAEFDDFRLKSAERHFAEAAKLDLPAPVLENVGRFRKKTEGLTGWRFSGGISPAVNRNANNAAPQYCRQNGGRQICSVSRAERAAGLNYEIEAEKLTPLADNHYLLFRSNIGGTSYYFSKKSAYDDGFGRAYLGWQYKNARQTAGILPFYQVQLSGSDGFDAKTKRVNNRRLPPYMLAHGVGVQLSHTYRPNPGWQFSVALEHYRQRYREQDRAEYNNGRQDGFYVSSAKRLGESATVFGGWQFVRFVPKRETVGGAVNNAAYRRNGVYAGWAQEWRQLGGLNSRVSASYARRNYKGIAAFSTEAQRNREWNVSLALSHDKLSYKGIVPALNYRFGRTESNVPYAKRRNSEVFVSADWRF

SEQ ID NO: 2873 - DNA, 1518 bp, Neisseria meningitidis
atgttgtatttcagatacggttttttggttgtttggtgtgcggcaggtgtttctgccgcctatggggcggatgcgcccgcgattttggatgacaaggcattgttgcaggtgcagcggtcggtgtcggataagtgggcggaatcggattggaaagttgacaatgatgccccgcgcgtggttgacggggattttttgttggcgcatccgaaaatgttggaacatagtttgcgcgacgtgctcaacggcaatcaggcggatttgatcgcttcgttggcggatttgtatgccaagctgccggattatgacgcggttttgtacggcagggcgcgggctttgctggcgaaattggcgggaaggccggcggaggcggtggcgcggtatcgggaactgcacggggaaaatgcggcagacgagcggattttgctggatttggcggcggcggagtttgacgatttccggctgaagtcggcagaaaggcattttgccgaggcggaaaaattggatttgccggcgccggttttggaaaatgtggggcgttttcggaaaaaagcggaggggctgacgggctggcgtttttcgggcggcatcagtccggcggtcaatagaaatgccaataatgccgcgccgcagtattgccggcaaaacggaggccggcagatatgcagtgtcagccgggcggagcgggcggcaggcttgaattatgaaatcgaggcggaaaaactgacggcgttggcagataatcattatttgttgttccgttccaatatcggcggcacgagctattatttcagtaaaaaatcagcttatgacgacgggttcggcagagcgtatttgggttggcagtataaaaatgcacggcagacggcggggattttgccgttttatcaggtgcagttgtcgggcagcgacggctttgatgcgaaaacaaaacgggtaaacaaccgccgcctgccgccgtatatgctggcgcacggagtcggcgtgcagttgtcccatacttaccgcccaaacccgggatggcaattttcggtcgcgctggaacattaccgccaacgctaccgcgaacaggatagggcggaatacaataacggtcggcaggacgggttttatgtttcgtcggcaaaacgtttgggcgaatcggcaactgtgttcggcggctggcagtttgtgcggtttgtgccgaaacgcgaaacggtgggcggcgcggtcaataatgccgcctaccggcgcaacggtgtttatgccggctgggcgcaggagtggcggcagttgggcggtttgaacagtcgggtttccgcgtcttatgcccgccgcaactataagggcgttgcggctttctcgacagaggcgcaacgcaaccgcgaatggaatgtctcgctggctttgagccacgacaagttgtcgtacaaaggtatcgtgcccgcgttgaattatcgtttcggcaggacggaaagtaatgtgccgtatgcgaaacgccgcaacagcgaggtgtttgtgtcggcggattggcggttttga

SEQ ID NO: 2874 - protein, 505 aa, Neisseria meningitidis
MLYFRYGFLVVWCAAGVSAAYGADAPAILDDKALLQVQRSVSDKWAESDWKVDNDAPRVVDGDFLLAHPKMLEHSLRDVLNGNQADLIASLADLYAKLPDYDAVLYGRARALLAKLAGRPAEAVARYRELHGENAADERILLDLAAAEFDDFRLKSAERHFAEAEKLDLPAPVLENVGRFRKKAEGLTGWRFSGGISPAVNRNANNAAPQYCRQNGGRQICSVSRAERAAGLNYEIEAEKLTALADNHYLLFRSNIGGTSYYFSKKSAYDDGFGRAYLGWQYKNARQTAGILPFYQVQLSGSDGFDAKTKRVNNRRLPPYMLAHGVGVQLSHTYRPNPGWQFSVALEHYRQRYREQDRAEYNNGRQDGFYVSSAKRLGESATVFGGWQFVRFVPKRETVGGAVNNAAYRRNGVYAGWAQEWRQLGGLNSRVSASYARRNYKGVAAFSTEAQRNREWNVSLALSHDKLSYKGIVPALNYRFGRTESNVPYAKRRNSEVFVSADWRF

SEQ ID NO: 2875 - DNA, 609 bp, Neisseria gonorrhoeae
atgaaacccaaaccacacaccgtccgcaccctgattgccgccgtcctcagccttgccctcggcggctgcttcagcgcagtcgtcggcggggccgccgtcggcgcaaaatccgtcatcgaccgccgaaccaccggcgcgcaaaccgatgacaacgttatggcgttgcgtatcgaaaccaccgcccgttcctacctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtatacaactacattaccgtcgcctccctgccgcgcactgcgggcgacatcgccggcgacacttggaacacgtccaaagtccgcgccacgctgctgggcatcagccccgctacacaggcgcgcgtcaaaatcattacctacggcaatgtaacctacgttatgggcatcctcacccccgaagaacaggcgcagattacccaaaaagtcagcaccaccgtcggcgtacaaaaagtcattaccctctaccaaaactacgtccaacgctga

SEQ ID NO: 2876 - protein, 202 aa, Neisseria gonorrhoeae
MKPKPHTVRTLIAAVLSLALGGCFSAVVGGAAVGAKSVIDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIITYGNVTYVMGILTPEEQAQITQKVSTTVGVQKVITLYQNYVQR

SEQ ID NO: 2877 - DNA, 384 bp, Neisseria meningitidis
atgaaacccaaaccgcacaccgtccgcaccctgattgccgccattttcagccttgcccttagcggctgcgtcagcgcagtaatcggaagcgccgccgtcggcgcgaaatccgccgtcgaccgccgaaccaccggcgcgcaaaccgacgacaacgttatggcgttgcgtatcgaaaccaccgcccgttcctatctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtgtacaactatattaccgtcgcctccctgccgcgcactgcc

SEQ ID NO: 2878 - protein, 128 aa, Neisseria meningitidis
MKPKPHTVRTLIAAIFSLALSGCVSAVIGSAAVGAKSAVDRRTTGAQTDDNVMALRIETTARSYLRQNNQTKGYTPQISVVGYNRHLLLLGQVATEGEKQFVGQIARSEQAAEGVYNYITVASLPRTA

SEQ ID NO: 2879 - DNA, 609 bp, Neisseria meningitidis
atgaaacccaaaccgcacaccgtccgcaccctgactgccgccgtcctcagccttgccctcggcggctgcgtcagcgcagtcgtcggcggcgcggcggtcggcgcgaaatccgccgtcgaccgccgaaccaccggcgcgcaaaccgacgacaacgtaatggcgctgcgtatcgaaaccaccgcccgctcctatctgcgccaaaacaaccaaaccaaaggctacacgccccaaatctccgttgtcggctacaaccgccacctgctgctgctcggacaagtcgccaccgaaggcgagaaacagttcgtcggtcagattgcacgttccgaacaggccgccgaaggcgtgtacaactacattaccgtcgcctccctgccgcgcactgccggcgacatcgccggcgacacttggaacacatccaaagtccgcgccacgctgttgggcatcagccccgccacacaggcgcgcgtcaaaatcgttacctacggcaacgtaacctacgttatgggcatcctcacccccgaagaacaggcgcagattacccaaaaagtcagcaccaccgtcggcgtacaaaaagtcatcaccctctaccaaaactacgtccaacgctga

SEQ ID NO: 2880 - protein, 202 aa, Neisseria meningitidis
MKPKPHTVRTLTAAVLSLALGGCVSAVVGGAAVGAKSAVDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIVTYGNVTYVMGILTPEEQAQITQKVSTTVGVQKVITLYQNYVQR

SEQ ID NO: 2881 - DNA, 609 bp, Neisseria gonorrhoeae; identical to SEQ ID NO: 2875

SEQ ID NO: 2882 - protein, 202 aa, Neisseria gonorrhoeae; identical to SEQ ID NO: 2876

SEQ ID NO: 2883 - DNA, 609 bp, Neisseria meningitidis
atgaaacccaaaccgcacaccgtccgcaccctgattgccgccattttcagccttgcccttagcggctgcgtcagcgcagtaatcggaagcgccgccgtcggcgcgaaatccgccgtcgaccgccgaaccaccggcgcgcaaaccgacgacaacgttatggcgttgcgtatcgaaaccaccgcccgttcctatctgcgccaaaacaaccaaaccaaaggctacacgccccaaatctccgtcgtcggctacaaccgccacctgctgctgctcggacaagtcgccaccgaaggcgaaaaacagttcgtcggtcagattgcacgttccgaacaggccgccgaaggcgtgtacaactatattaccgtcgcctccctgccgcgcactgccggcgacatcgccggcgacacttggaacacatccaaagtccgcgccacgctgttgggcatcagccccgccacacaggcgcgcgtcaaaatcgttacctacggcaacgtaacctacgttatgggcatcctcacccccgaagaacaggcgcagattacccaaaaagtcagcaccaccgtcggcgtacaaaaagtcatcaccctctaccaaaactacgtccaacgctga

SEQ ID NO: 2884 - protein, 202 aa, Neisseria meningitidis
MKPKPHTVRTLIAAIFSLALSGCVSAVIGSAAVGAKSAVDRRTTGAQTDDNVMALRIETTARSYLRQNNQTKGYTPQISVVGYNRHLLLLGQVATEGEKQFVGQIARSEQAAEGVYNYITVASLPRTAGDIAGDTWNTSKVRATLLGISPATQARVKIVTYGNVTYVMGILTPEEQAQITQKVSTTVGVQKVITLYQNYVQR

SEQ ID NO: 2885 - DNA, 609 bp, Neisseria meningitidis; identical to SEQ ID NO: 2879

SEQ ID NO: 2886 - protein, 202 aa, Neisseria meningitidis; identical to SEQ ID NO: 2880

SEQ ID NO: 2887 - DNA, 867 bp, Neisseria gonorrhoeae
atgaaaaatattctcttagtatttgttagctttgtgccattatgtgtccgcactgatctgccgctgaatatcgaagacataatgaccgacaagggaaaatggaaactggaaacttcccttacctacctgaacagcgaaaacagccgcgccgcacttgcctcaccggtttacattcagaccggctccgcttcctttatccccgtcccgaccgaaattcaggaaaacggcagcaataccgatatgctcgccggcacgctcggtttgcgctacggactgaccggcaataccgacatttacggcagcggcagctatctgtggcacgaagaacgcaaactcgacggcaacggcaaaacccgcaacaaacggatgtccgacatatccgccggcatcagccacaccttccttaaagacggcaaaaatcccgcactcatcgctttcctcgaaagcacggtttacgaaaaatcgcgcaacaaagcctcgtcgggaaaatcgtggctcatcggcgccaccacctacaaagccatagatccgattgtcctttccctcaccgccgcctaccgcatcaacggcagcaaaaccctttcagacgacgtcaaatacaaagcaggcaattactggatgctgaatcccaacatctcatttgccgccaacgacagaatcagcctgaccggaggcatccaatggctgggcaaacagcccgaccgcatagacggcaaaaaagaatccgcaagaaacacatccacctacgcccatttcggcgcaggtttcggtttcaccaaaaccgcggctttaaacgcatccgcacgtttcaacgtttcagggcaaagcagttccgaactgaaattgggcgtacagcatacattttaa

SEQ ID NO: 2888 - protein, 288 aa, Neisseria gonorrhoeae
MKNILLVFVSFVPLCVRTDLPLNIEDIMTDKGKWKLETSLTYLNSENSRAALASPVYIQTGSASFIPVPTEIQENGSNTDMLAGTLGLRYGLTGNTDIYGSGSYLWHEERKLDGNGKTRNKRMSDISAGISHTFLKDGKNPALIAFLESTVYEKSRNKASSGKSWLIGATTYKAIDPIVLSLTAAYRINGSKTLSDDVKYKAGNYWMLNPNISFAANDRISLTGGIQWLGKQPDRIDGKKESARNTSTYAHFGAGFGFTKTAALNASARFNVSGQSSSELKLGVQHTF

SEQ ID NO: 2889 - DNA, 870 bp, Neisseria meningitidis; identical to SEQ ID NO: 1817

SEQ ID NO: 2890 - protein, 289 aa, Neisseria meningitidis; identical to SEQ ID NO: 1818

SEQ ID NO: 2891 - DNA, 870 bp, Neisseria meningitidis; identical to SEQ ID NO: 1819

SEQ ID NO: 2892 - protein, 289 aa, Neisseria meningitidis; identical to SEQ ID NO: 1820

SEQ ID NO: 2893 - DNA, 222 bp, Neisseria meningitidis
atgaaacgattgactttattggcctttgttttggctgccggtgcggtttccgcctctcccaaagcagacgtggaaaaaggcaaacaggttgccgcaacggtttgtgcggcttgccatgcagcagacggtaacagcggcattgcgatgtatccgcgtttggcggcacagcatactgcttacatctatcatcaaactatcggcatccgcgacgtaaacgcaccc

SEQ ID NO: 2894 - protein, 74 aa, Neisseria meningitidis
MKRLTLLAFVLAAGAVSASPKADVEKGKQVAATVCAACHAADGNSGIAMYPRLAAQHTAYIYHQTIGIRDVNAP

SEQ ID NO: 2895 - DNA, 624 bp, Neisseria meningitidis
atgaaacgattgactttattggcctttgttttggctgccggtgcggtttccgcatctcccaaagcagacgtggaaaaaggcaaacaggttgccgcaacggtttgtgcggcttgccatgcagcagacggtaacagcggcattgcgatgtatccgcgtttggcggcacagcatactgcttacatctatcatcaaaccatcggcatccgcgacggtaaacgcacccacggttcggcagctgtgatgaaaccggtggtaatgaatttgagcgatcaggatattttgaacgtatccgcattctatgccaaacagcagcccaaatccggtgaagccaatcctaaggaaaatcccgaattgggtgcgaaaatctatcgcggcggtttgagcgataaaaaagtgccggcgtgtatgtcctgccacggtccgagcggtgcgggtatgccggggggcggaagcgaaattcaggcttatccgcgtttgggcggtcagcatcaggcatatattgttgaacagatgaatgcctacaagtccggtcagcgtaaaaataccatcatggaagatattgcaaaccgtatgtctgaagaagatttgaaagcggtcgccaactttatccaaggtttgcgttaa

SEQ ID NO: 2896 - protein, 207 aa, Neisseria meningitidis
MKRLTLLAFVLAAGAVSASPKADVEKGKQVAATVCAACHAADGNSGIAMYPRLAAQHTAYIYHQTIGIRDGKRTHGSAAVMKPVVMNLSDQDILNVSAFYAKQQPKSGEANPKENPELGAKIYRGGLSDKKVPACMSCHGPSGAGMPGGGSEIQAYPRLGGQHQAYIVEQMNAYKSGQRKNTIMEDIANRMSEEDLKAVANFIQGLR

SEQ ID NO: 2897 - DNA, 339 bp, Neisseria gonorrhoeae; identical to SEQ ID NO: 2407

SEQ ID NO: 2898 - protein, 112 aa, Neisseria gonorrhoeae; identical to SEQ ID NO: 2408

SEQ ID NO: 2899 - DNA, 309 bp, Neisseria meningitidis; identical to SEQ ID NO: 2409

SEQ ID NO: 2900 - protein, 102 aa, Neisseria meningitidis; identical to SEQ ID NO: 2410

SEQ ID NO: 2901 - DNA, 309 bp, Neisseria meningitidis; identical to SEQ ID NO: 2411

SEQ ID NO: 2902 - protein, 102 aa, Neisseria meningitidis; identical to SEQ ID NO: 2410

SEQ ID NO: 2903 - DNA, 1845 bp, Neisseria gonorrhoeae
atgattatgttacccgcccgtttcactattttatctgtcctcgcagcagccctgcttgccggacaggcgtatgctgccggcgcggcggatgtggagctgccgaaggaagtcggaaaggttttaaggaaacatcggcgttacagcgaggaagaaatcaaaaacgaacgcgcacggcttgcggcagtgggcgaacgggtcaacagggtgtttacgctgttgggcggtgaaacggctttgcagaaagggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagatcgagcctataccgggtgaggcgcaaaaacgggcggggtggctgcggaacgtattgagggaagggggaaatcagcatctggacgggttggaagaggtgctggcgcaatcggacgatgtgcaaaaacgcaggatatttttgctgctggtgcaagccgccgtgcagcagggtggggtggctcaaaaagcatcgaaagcggttcgccgtgcggcgttgaagtatgaacatctgcccgaagcggcggttgccgatgcggtgttcggcgtacagggacgcgaaaaggaaaaggcaatcgaagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcgtaagccggatgatgcctatgcgcgtttgaacgtgctgttggaacacaacccgaatgcaaacctgtatattcaggcggcgatattggcggcaaaccgaaaagaaggtgcgtccgttatcgacggctacgccgaaaaggcatacggcagggggacgggggaacagcggggcagggcggcaatgacggcggcgatgatatatgccgaccgcagggattacgccaaagtcaggcagtggttgaaaaaagtgtccgcgccggaatacctgttcgacaaaggcgtgctggcggctgcggcggctgccgaattggacggaggccgggcggctttgcggcagatcggcagggtgcggaaacttcccgaacagcaggggcggtattttacggcagacaatttgtccaaaatacagatgctcgccctgtcgaagctgcccgacaaacgggaagccctgatcgggctgaacaacatcatcgccaaactttcggcggcgggaagcacggaacctttggcggaagcattggcacagcgttccattatttacgaacagttcggcaaacggggaaaaatgattgccgaccttgaaaccgcgctcaaacttacgcccgataatgcacaaattatgaataatctgggctacagcctgctttccgattccaaacgtttggacgagggtttcgccctgcttcagacggcataccaaatcaacccggacgataccgccgttaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttaggggagacaagaaaatatggcgggagacgctcaaacgctacggaatcgccttgcccgagccttcccgaaaaccccggaaataa

SEQ ID NO: 2904 - protein, 614 aa, Neisseria gonorrhoeae
MIMLPARFTILSVLAAALLAGQAYAAGAADVELPKEVGKVLRKHRRYSEEEIKNERARLAAVGERVNRVFTLLGGETALQKGQAGTALATYMLMLERTKSPEVAERALEMAVSLNAFEQAEMIYQKWRQIEPIPGEAQKRAGWLRNVLREGGNQHLDGLEEVLAQSDDVQKRRIFLLLVQAAVQQGGVAQKASKAVRRAALKYEHLPEAAVADAVFGVQGREKEKAIEALQRLAKLDTEILPPTLMTLRLTARKYPEILDGFFEQTDTQNLSAVWQEMEIMNLVSLRKPDDAYARLNVLLEHNPNANLYIQAAILAANRKEGASVIDGYAEKAYGRGTGEQRGRAAMTAAMIYADRRDYAKVRQWLKKVSAPEYLFDKGVLAAAAAAELDGGRAALRQIGRVRKLPEQQGRYFTADNLSKIQMLALSKLPDKREALIGLNNIIAKLSAAGSTEPLAEALAQRSIIYEQFGKRGKMIADLETALKLTPDNAQIMNNLGYSLLSDSKRLDEGFALLQTAYQINPDDTAVNDSIGWAYYLKGDAESALPYLRYSFENDPEPEVAAHLGEVLWALGERDQAVDVWTQAAHLRGDKKIWRETLKRYGIALPEPSRKPRK

SEQ ID NO: 2905 - DNA, 1851 bp, Neisseria meningitidis
atgattatgttacctaaccgtttcaaaatgttaactgtgttgacggcaaccttgattgccggacaggtatctgccgccggaggcggtgcgggggatatgaaacagccgaaggaagtcggaaaggttttcagaaagcagcagcgttacagcgaggaagaaatcaaaaacgaacgcgcacggcttgcggcagtgggcgagcgggttaatcagatatttacgttgctgggaggggaaaccgccttgcaaaaggggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagattgagcctataccgggtaaggcgcaaaaacgggcggggtggctgcggaacgtgctgagggaaagaggaaatcagcatctggacggactggaagaagtgctggctcaggcggacgaaggacagaaccgcagggtgtttttattgttggcacaagccgccgtgcaacaggacgggttggcgcaaaaagcatcgaaagcggttcgccgcgcggcgttgaaatatgaacatctgcccgaagcggcggttgccgatgtggtgttcagcgtacagggacgcgaaaaggaaaaggcaatcggagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcacaggctggatgatgcctatgcgcgtttgaacgtgctgttggaacgcaatccgaatgcagacctgtatattcaggcagcgatattggcggcaaaccgaaaagaaggtgcttccgttatcgacggctacgccgaaaaggcatacggcagggggacggaggaacagcggagcagggcggcgctaacggcggcgatgatgtatgccgaccgcagggattacgccaaagtcaggcagtggctgaaaaaagtatccgcgccggaatacctgttcgacaaaggtgtgctggcggctgcggcggctgtcgagttggacggcggcagggcggctttgcggcagatcggcagggtgcggaaacttcccgaacagcaggggcggtattttacggcagacaatttgtccaaaatacagatgctcgccctgtcgaagctgcccgataaacgggaggctttgagggggttggacaagattatcgaaaaaccgcctgccggcagtaatacagagttacaggcagaggcattggtacagcggtcagttgtttacgatcggcttggcaagcggaaaaaaatgatttcagatcttgaaagggcgttcaggcttgcacccgataacgctcagattatgaataatctgggctacagcctgctgaccgattccaaacgtttggacgaaggtttcgccctgcttcagacggcataccaaatcaacccggacgataccgctgtcaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttacgggagacaagaaaatatggcgggaaacgctcaaacgtcacggcatcgcattgccccaaccttcccgaaaacctcggaaataa

SEQ ID NO: 2906 - protein, 616 aa, Neisseria meningitidis
MIMLPNRFKMLTVLTATLIAGQVSAAGGGAGDMKQPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGLEEVLAQADEGQNRRVFLLLAQAAVQQDGLAQKASKAVRRAALKYEHLPEAAVADVVFSVQGREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEGASVIDGYAEKAYGRGTEEQRSRAALTAAMMYADRRDYAKVRQWLKKVSAPEYLFDKGVLAAAAAVELDGGRAALRQIGRVRKLPEQQGRYFTADNLSKIQMLALSKLPDKREALRGLDKIIEKPPAGSNTELQAEALVQRSVVYDRLGKRKKMISDLERAFRLAPDNAQIMNNLGYSLLTDSKRLDEGFALLQTAYQINPDDTAVNDSIGWAYYLKGDAESALPYLRYSFENDPEPEVAAHLGEVLWALGERDQAVDVWTQAAHLTGDKKIWRETLKRHGIALPQPSRKPRK

SEQ ID NO: 2907 - DNA, 1839 bp, Neisseria meningitidis
atgttacccgcccgtttcaccattttatctgtgctcgcggcagccctgcttgccgggcaggcgtatgccgccggcgcggcggatgcgaagccgccgaaggaagtcggaaaggttttcagaaagcagcagcgttacagcgaggaagaaatcaaaaacgaacgcgcacggcttgcggcagtgggcgagcgggttaatcagatatttacgttgctgggaggggaaaccgccttgcaaaaggggcaggcgggaacggctctggcaacctatatgctgatgttggaacgcacaaaatcccccgaagtcgccgaacgcgccttggaaatggccgtgtcgctgaacgcgtttgaacaggcggaaatgatttatcagaaatggcggcagattgagcctataccgggtaaggcgcaaaaacgggcggggtggctgcggaacgtgctgagggaaagaggaaatcagcatctagacggactggaagaagtgctggctcaggcggacgaaggacagaaccgcagggtgtttttattgttggcacaagccgccgtgcaacaggacgggttggcgcaaaaagcatcgaaagcggttcgccgcgcggcgttgagatatgaacatctgcccgaagcggcggttgccgatgtggtgttcagcgtacagggacgcgaaaaggaaaaggcaatcggagctttgcagcgtttggcgaagctcgatacggaaatattgccccccactttaatgacgttgcgtctgactgcacgcaaatatcccgaaatactcgacggctttttcgagcagacagacacccaaaacctttcggccgtctggcaggaaatggaaattatgaatctggtttccctgcacaggctggatgatgcctatgcgcgtttgaacgtgctgttggaacgcaatccgaatgcagacctgtatattcaggcagcgatattggcggcaaaccgaaaagaaggtgcttccgttatcgacggctacgccgaaaaggcatacggcagggggacgggggaacagcggggcagggcggcaatgacggcggcgatgatatatgccgaccgaagggattacaccaaagtcaggcagtggttgaaaaaagtgtccgcgccggaatacctgttcgacaaaggtgtgctggcggctgcggcggctgtcgagttggacggcggcagggcggctttgcggcagatcggcagggtgcggaaacttcccgaacagcaggggcggtattttacggcagacaatttgtccaaaatacagatgttcgccctgtcgaagctgcccgacaaacgggaggctttgagggggttggacaagattatcgaaaaaccgcctgccggcagtaatacagagttacaggcagaggcattggtacagcggtcagttgtttacgatcggcttggcaagcggaaaaaaatgatttcagatcttgaaagggcgttcaggcttgcacccgataacgctcagattatgaataatctgggctacagcctgctttccgattccaaacgtttggacgaaggcttcgccctgcttcagacggcataccaaatcaacccggacgataccgctgtcaacgacagcataggctgggcgtattacctgaaaggcgacgcggaaagcgcgctgccgtatctgcggtattcgtttgaaaacgaccccgagcccgaagttgccgcccatttgggcgaagtgttgtgggcattgggcgaacgcgatcaggcggttgacgtatggacgcaggcggcacaccttacgggagacaagaaaatatggcgggaaacgctcaaacgtcacggcatcgcattgccccaaccttcccgaaaacctcggaaataa

SEQ ID NO: 2908 - protein, 612 aa, Neisseria meningitidis
MLPARFTILSVLAAALLAGQAYAAGAADAKPPKEVGKVFRKQQRYSEEEIKNERARLAAVGERVNQIFTLLGGETALQKGQAGTALATYMLMLERTKSPEVAERALEMAVSLNAFEQAEMIYQKWRQIEPIPGKAQKRAGWLRNVLRERGNQHLDGLEEVLAQADEGQNRRVFLLLAQAAVQQDGLAQKASKAVRRAALRYEHLPEAAVADVVFSVQGREKEKAIGALQRLAKLDTEILPPTLMTLRLTARKYPEILDGFFEQTDTQNLSAVWQEMEIMNLVSLHRLDDAYARLNVLLERNPNADLYIQAAILAANRKEGASVIDGYAEKAYGRGTGEQRGRAAMTAAMIYADRRDYTKVRQWLKKVSAPEYLFDKGVLAAAAAVELDGGRAALRQIGRVRKLPEQQGRYFTADNLSKIQMFALSKLPDKREALRGLDKIIEKPPAGSNTELQAEALVQRSVVYDRLGKRKKMISDLERAFRLAPDNAQIMNNLGYSLLSDSKRLDEGFALLQTAYQINPDDTAVNDSIGWAYYLKGDAESALPYLRYSFENDPEPEVAAHLGEVLWALGERDQAVDVWTQAAHLTGDKKIWRETLKRHGIALPQPSRKPRK

SEQ ID NO: 2909 - DNA, 609 bp, Neisseria gonorrhoeae
ttgtcttatcgtttgaatgctgcaccgatgtttaacgataatcctgttgtttacggaaaaatcaaattgcagagttggaaagcgcggcgggatttcaatattgtaaagcaggatttggatttttcctgcggggcggcttcggtggcgacgcttttgaacaatttttacgggcaaaagctgacggaagaagaagtgttggaaaaactgggtaaggaacagatgcgcgcgtcgtttgaggatatgcggcgcattatgcccgatttgggttttgaggcgaaaggctatgccctgtctttcgaacagctcgcgcagttgaaaatccccgtcatcgtgtatctgaaataccgcaaagacgaccatttttcggtattgcgcggagtggatggcaatacggttttgcttgccgacccgtcgccgggtcatgtttcgatgagcagggcgcagtttttggaggcttggcaaacccgtgagggaaatttggcaggcaaaattttggcggtcgtgccgaaaaaagcggaggcgatttcaaataaattgtttttcacacatcatcccaagcggcagacggagtttgcagtcggacaggtaaaatggtggcgtgcttattga

SEQ ID NO: 2910 - protein, 202 aa, Neisseria gonorrhoeae
LSYRLNAAPMFNDNPVVYGKIKLQSWKARRDFNIVKQDLDFSCGAASVATLLNNFYGQKLTEEEVLEKLGKEQMRASFEDMRRIMPDLGFEAKGYALSFEQLAQLKIPVIVYLKYRKDDHFSVLRGVDGNTVLLADPSPGHVSMSRAQFLEAWQTREGNLAGKILAVVPKKAEAISNKLFFTHHPKRQTEFAVGQVKWWRAY

SEQ ID NO: 2911 - DNA, 657 bp, Neisseria meningitidis
atgatgaagttcaaatatgtttttctgttggcgtgtgttgtcgtttctttatcttatcgtttgaatgctgcaccgatgtttaacgataatcctgttgtttacggaaaaatcaaagtgcagagttggaaagcgcggcgggatttcaatattgtaaagcaggatttggatttttcctgtggggcggcttcggtggcgacgcttttgaacaatttttacgggcaaacgctgacggaagaagaagtgttgaaaaagctggataaggagcagatgcgcgcgtcgtttgaggatatgcggcgcattatgcctgatttgggttttgaggcgaagggctatgccctgtctttcgagcagctcgcgcagttgaaaatccccgtcatcgtgtatctgaaataccgcaaagacgaccatttttcggtattgcgcggtatagacggcaatacggttttgcttgccgacccgtcgctggggcatgtttcaatgagcagggcgcagtttttggatgcttggcaaacccgtgagggaaatttggcaggtaagattttggctgtcataccgaaaaaagccgagacaatttcaaataaattgtttttcacacaacacccaaaacggcagacggagtttacagtcggacaaatcaggcaagcacgtgcagagtaa

SEQ ID NO: 2912 - protein, 218 aa, Neisseria meningitidis
MMKFKYVFLLACVVVSLSYRLNAAPMFNDNPVVYGKIKVQSWKARRDFNIVKQDLDFSCGAASVATLLNNFYGQTLTEEEVLKKLDKEQMRASFEDMRRIMPDLGFEAKGYALSFEQLAQLKIPVIVYLKYRKDDHFSVLRGIDGNTVLLADPSLGHVSMSRAQFLDAWQTREGNLAGKILAVIPKKAETISNKLFFTQHPKRQTEFTVGQIRQARAE

SEQ ID NO: 2913 - DNA, 657 bp, Neisseria meningitidis
  misc_feature (497)..(497): n is a, c, g, or t
atgatgaagttcaaatatgtttttctgttggcgtgtgttgtcgtttctttatcttatcgtttgaatgctgcaccgatgtttaacgataatcctgttgtttacggaaaaatcaaagtgcagagttggaaagaaaggcgggatttcaatattgtaaagcaggatttggatttttcctgcggggcggcttcggtggcgacgcttttgaacaatttttacgggcaaacgctgacggaagaagaagtgttgaaaaagctggataaggagcagatgcgcgcgtcgtttgaggatatgcggcgcattatgccagatttgggttttgaagcgaaaggctatgccctgtctttcgagcagctcgcacagttgaaaatccccgtcatcgtgtatctgaaataccgcaaggatgatcatttctcggtattgcgcgggatagacggcaatacggttttgcttgccgacccgtcgctgggtcatgtttcaatgagcagggcgcagttttnggatgcttggcaaacccgtgagggaaatttggcaggtaagattttggcggtcgtgccgaaaaaagccgagacaatttcaaataaattgtttttcacacatcatcccaagcggcagacggagtttgcagtcggacaaatcaggcaagcacgtgcagagtaa

SEQ ID NO: 2914 - protein, 218 aa, Neisseria meningitidis
  misc_feature (166)..(166): Xaa can be any naturally occurring amino acid
MMKFKYVFLLACVVVSLSYRLNAAPMFNDNPVVYGKIKVQSWKERRDFNIVKQDLDFSCGAASVATLLNNFYGQTLTEEEVLKKLDKEQMRASFEDMRRIMPDLGFEAKGYALSFEQLAQLKIPVIVYLKYRKDDHFSVLRGIDGNTVLLADPSLGHVSMSRAQFXDAWQTREGNLAGKILAVVPKKAETISNKLFFTHHPKRQTEFAVGQIRQARAE

SEQ ID NO: 2915 - DNA, 561 bp, Neisseria gonorrhoeae
atgaaaaaaatcatcttcgccgcgctcgcagcggcagccgtcggcactgcctccgccacctacaaagtggacgaatatcacgccaacgtccgtttcgccatcgaccacttcaacaccagcaccaacgtcggcggtttttacggtctgaccggttccgtcgagttcgatcaagcaaaacgcgacggcaaaatcgacatcaccattcccgtcgccaacctgcaaagcggttcgcaacccttcaccggccacctgaaatccgccgacatcttcgatgccgctcaatatccggacatccgcttcgtttccaccaaattcaacttcaacggcaaaaaacttgtttccgttgacggcaacctgaccatgcgcggcaaaaccgcccccgtcaaactcaaagccgaaaaattcaactgctaccaaagcccgatggcggaaaccgaagtttgcggcggcgacttcagcaccaccatcgaccgcaccaaatggggcgtggactacctcgttaacgccggtatgaccaaaaacgtccgcatcgacatccaaatcgaagctgcaaaacaataa

SEQ ID NO: 2916 - protein, 186 aa, Neisseria gonorrhoeae
MKKIIFAALAAAAVGTASATYKVDEYHANVRFAIDHFNTSTNVGGFYGLTGSVEFDQAKRDGKIDITIPVANLQSGSQPFTGHLKSADIFDAAQYPDIRFVSTKFNFNGKKLVSVDGNLTMRGKTAPVKLKAEKFNCYQSPMAETEVCGGDFSTTIDRTKWGVDYLVNAGMTKNVRIDIQIEAAKQ

SEQ ID NO: 2917 - DNA, 564 bp, Neisseria meningitidis
atgaaaaaaatcatcttcgccgcactcgcagccgccgccatcagtactgcctccgccgccacctacaaagtggacgaatatcacgccaacgcccgtttcgccatcgaccatttcaacaccagcaccaacgtcggcggtttttacggtctgaccggttccgtcgagttcgaccaagcaaaacgcgacggtaaaatcgacatcaccatccccattgccaacctgcaaagcggttcgcaacactttaccgaccacctgaaatcagccgacatcttcgatgccgcccaatatccggacatccgctttgtttccaccaaattcaacttcaacggcaaaaaactggtttccgttgacggcaacctgaccatgcacggcaaaaccgcccccgtcaaactcaaagccgaaaaattcaactgctaccaaagcccgatggagaaaaccgaagtttgtggcggcgacttcagcaccaccatcgaccgcaccaaatggggcatggactacctcgttaacgttggtatgaccaaaagcgtccgcatcgacatccaaatcgaggcagccaaacaataa

SEQ ID NO: 2918 - protein, 187 aa, Neisseria meningitidis
MKKIIFAALAAAAISTASAATYKVDEYHANARFAIDHFNTSTNVGGFYGLTGSVEFDQAKRDGKIDITIPIANLQSGSQHFTDHLKSADIFDAAQYPDIRFVSTKFNFNGKKLVSVDGNLTMHGKTAPVKLKAEKFNCYQSPMEKTEVCGGDFSTTIDRTKWGMDYLVNVGMTKSVRIDIQIEAAKQ

SEQ ID NO: 2919 - DNA, 564 bp, Neisseria meningitidis
atgaaaaaaatcatcatcgccgcgctcgcagcagccgccatcggcactgcctccgccgccacctacaaagtggacgaatatcacgccaacgcccgtttctctatcgaccatttcaacaccagcaccaacgtcggcggtttttacggtctgaccggttccgttgagttcgaccaagcaaaacgcgacggtaaaatcgacatcaccatccccgttgccaacctgcaaagcggttcgcaacactttaccgaccacctgaaatcagccgacatcttcgatgccgcccaatatccggacatccgctttgtttccaccaaattcaacttcaacggcaaaaaactggtttccgttgacggcaacctgaccatgcacggcaaaaccgcccccgtcaaactcaaagccgaaaaattcaactgctaccaaagcccgatgttgaaaaccgaagtttgcggcggcgacttcagcaccaccatcgaccgcaccaaatggggcatggactacctcgttaacgttggtatgaccaaaagcgtccgcatcgacatccaaatcgaggcagccaaacaataa

SEQ ID NO: 2920 - protein, 187 aa, Neisseria meningitidis
MKKIIIAALAAAAIGTASAATYKVDEYHANARFSIDHFNTSTNVGGFYGLTGSVEFDQAKRDGKIDITIPVANLQSGSQHFTDHLKSADIFDAAQYPDIRFVSTKFNFNGKKLVSVDGNLTMHGKTAPVKLKAEKFNCYQSPMLKTEVCGGDFSTTIDRTKWGMDYLVNVGMTKSVRIDIQIEAAKQ

SEQ ID NO: 2921 - DNA, 477 bp, Neisseria meningitidis
atgaaaaagttttattttgtgctgctggcgttgggtttggcagcgtgtgggcaagaacaatcgcagaaagctgatgcggagcagtatttttttgccaataaatatcaatttgcagatgagaaacaggctttttattttgaacgcgccgcccgtttccgtgtattgcaacaaggccttggcggggattttgagaggtttttaaaaggagaaatacctaatcaagaaaatcttgcaaagtatcgtgaaaatattactcaagcagtcgcttattatgcggacacgaatggagatgatgacccataccgcgtctgcaaacaggctgcgcaagatgcagaaatcctgatgaagagtatggtaacaagcggtggaggcggtacaactgatttagataaggaaagttatcaaaattaccgaaaatcaatgcaagaatgccgtaaaacaataacggaagctgaagccaatttgccgaaaaaataa

SEQ ID NO: 2922 - protein, 158 aa, Neisseria meningitidis
MKKFYFVLLALGLAACGQEQSQKADAEQYFFANKYQFADEKQAFYFERAARFRVLQQGLGGDFERFLKGEIPNQENLAKYRENITQAVAYYADTNGDDDPYRVCKQAAQDAEILMKSMVTSGGGGTTDLDKESYQNYRKSMQECRKTITEAEANLPKK

SEQ ID NO: 2923 - DNA, 993 bp, Neisseria gonorrhoeae
atgtttaaaaaattcaaaccggtactgttgtcattttttgcacttgtatttgccttttggctgggaacaggtattgcctatgagattaatccgcgttggtttttgagcgatacggcaactgaagtacctgaaaatccgaatgcttttgtggcgaaacttgcccgcctgttccgaaatgccgacagggcggttgtcatcgtgaaggaatcgatgaggacggaggaaagccttgccggagctgtggatgacggtccgttgcagtcggagaaggattatctcgcgctcgctatccggctcagtcgtttgaaagaaaaggcgaaatggtttcacgtaacggagcaggaacatggggaagaggtttggctggattactatatcggcgagggcggtttggttgcggtttcgctttcgcaacgctcgccggaagcgtttgttaatgccgaatatctgtatcggaacgatcgtccgttttctgtaaatgtgtacggcggaacggctcacggggaaaattatgaaacgacaggagaatatcgggttgtttggcaaccggacggttcggtatttgatgcggcggggcgcgggaaaatcggggaagatgtttatgagcattgcctcgggtgttatcagatggcccaggtatatttggcgaaataccgggatgtcgcgaatgacgagcagaaggtttgggacttccgcgaagagagcaaccggattgcatcggactcgcgcgattatgtgttttatcagaatatgcgggaattgatgccccgggggatgaaggcgaacagtcttgtggtcggctatgatgcggacggtctgccgcaaaaagtctattggagtgtcgacaatggaaaaaaaccccaaagtgtcgaatattatttgaaaaacggaaatctttttattgcccaatcttcgacggtaaccttgaaaacggatggcgtaacggcggatatgcaaacctatcatgcgcaacaaacgttgtatttggatggg

SEQ ID NO: 2924 - protein, 331 aa, Neisseria gonorrhoeae
MFKKFKPVLLSFFALVFAFWLGTGIAYEINPRWFLSDTATEVPENPNAFVAKLARLFRNADRAVVIVKESMRTEESLAGAVDDGPLQSEKDYLALAIRLSRLKEKAKWFHVTEQEHGEEVWLDYYIGEGGLVAVSLSQRSPEAFVNAEYLYRNDRPFSVNVYGGTAHGENYETTGEYRVVWQPDGSVFDAAGRGKIGEDVYEHCLGCYQMAQVYLAKYRDVANDEQKVWDFREESNRIASDSRDYVFYQNMRELMPRGMKANSLVVGYDADGLPQKVYWSVDNGKKPQSVEYYLKNGNLFIAQSSTVTLKTDGVTADMQTYHAQQTLYLDG

SEQ ID NO: 2925 - DNA, 1134 bp, Neisseria meningitidis; identical to SEQ ID NO: 2459

SEQ ID NO: 2926 - protein, 377 aa, Neisseria meningitidis; identical to SEQ ID NO: 2460

SEQ ID NO: 2927 - DNA, 1125 bp, Neisseria meningitidis; identical to SEQ ID NO: 2461

SEQ ID NO: 2928 - protein, 374 aa, Neisseria meningitidis; identical to SEQ ID NO: 2462

SEQ ID NO: 2929 - DNA, 2406 bp, Neisseria gonorrhoeae
ttggctcgtttattttcactcaaaccactggtgctggcattgggcttctgtttcggcacgcattgcgccgccgataccgttgcggcggaagaggcggacgggcgtgtcgcagaaggcggtgcgcagggcgcgtccgaatccgcacaagcttccgatttgaccctcggttcgacctgcctgttttgcagtaacgaaagcggcagccccgagagaaccgaagccgccgtccaaggcagcggcgaagcatccgtccccgaagactatacgcgcattgttgccgacaggatggaaggacagtcgaaggttaaggtgcgcgcggaaggaagcgttatcatcgaacgggacggcgcagtcctcaataccgattgggcggattacgaccagtcgggcgacaccgttaccgtaggcgaccggttcgccctccaacaggacggtacgctgattcggggcgaaaccctgacctacaatctcgatcagcagaccggcgaagcgcacaacgtccgtatggaaaccgaacaaggcggacggcggctgcaaagcgtcagccgcaccgccgaaatgttgggcgaagggcgttacaaactgacggaaacccaattcaacacctgttccgccggagatgccggctggtatgtcaaggccgcctctgtcgaagccgatcggggaaaaggcataggcgttgccaaacacgccgccttcgtgttcggcggcgttccccttttctatacgccttgggcggacttcccgcttgacggcaaccgcaaaagcggactgctcgtcccgtccgtatctgccggttcggacggcgtttccctttccgtcccctattatttcaaccttgcccccaacttcgatgccactttcgcccccggcattatcggcgaacgcggcgcgacgtttgacggacaaatccgttacctgcgtcccgattacagcggacagaccgacctgacctggttgccgcacgataagaaaagcggcaggaacaaccgctatcaggcaaaatggcagcaccggcacgacatttccgacacgcttcaggcgggtgtcgatttcaaccaagtctccgacagcggctactaccgcgacttttacggcggcgaagaaatcgccggcaacgtcaacctcaaccgccgcgtatggctggattatggcggcagggcggcgggaggcagcctgaatgccggcctttcggttcagaaataccagacgctggcaaaccaaagcggctacaaagacgaaccttacgccatcatgccccgcctttctgccgattggcataaaaacgcaggcagggcgcaaatcggcgtgtccgcacaatttacccgcttcagccacgacggccgccaagacggcagccgactggtcgtgtatcccggtatcaaatgggatttcagcaacagctggggctacgtccgccccaaactcgggctgcacgccacttattacagcctcgacagtttcggcggcaaagcatcccgcagcgtcgggcgcgttttgcccgttgtcaatatcgacggcggcacaaccttcgaacgcaatacgcgcctgttcggcggcggagtcgtgcaaaccatcgagccgcgcctgttctacaactatattcctgccaaatctcaaaacgacctgcccaatttcgattcgtcggaaagcagcttcggctacgggcagcttttccgcgaaaacctctattacggcaacgaccgcatcaacgccgccaacagcctttccaccgccgtgcagagccgtattttggacggcgcgacgggggaggagcgtttccgcgccggtatcggtcagaaattctatttcaaggatgatgcggtgatgcttgacggcagcgtcggcaaaaatccgcgcagccgttccgactgggtggcattcgcctccggcggcataggcgggcgtttcaccctcgacagcagcatccactacaaccaaaacgacaaacgcgccgaacattacgccgtcggcgcaggctaccgccccgcccccggaaaagtgttgaacgcccgctacaaatacgggcgcaacgaaaaaatctacctgcaggcggacggttcctatttttacgacaaactcagccagctcgacctgtccgcacaatggccgctgacgcgcaacctgtctgccgtcgtccgctacaactacggttttgaagccaaaaaaccgatagaaatgcttgccggtgcagaatacaaaagcagttgcggctgctggggcgcgggcgtgtacgcccaacgctacgttaccggcgaaaacacctacaaaaacgccgtctttttttcacttcagttgaaagacctcagcagcgtcggcagaaaccccgcaggcaggatggatgtcgccgttcccggctacatccccgcccactctctttccgccggacgcaacaaacggccctga

SEQ ID NO: 2930 - protein, 801 aa, Neisseria gonorrhoeae
LARLFSLKPLVLALGFCFGTHCAADTVAAEEADGRVAEGGAQGASESAQASDLTLGSTCLFCSNESGSPERTEAAVQGSGEASVPEDYTRIVADRMEGQSKVKVRAEGSVIIERDGAVLNTDWADYDQSGDTVTVGDRFALQQDGTLIRGETLTYNLDQQTGEAHNVRMETEQGGRRLQSVSRTAEMLGEGRYKLTETQFNTCSAGDAGWYVKAASVEADRGKGIGVAKHAAFVFGGVPLFYTPWADFPLDGNRKSGLLVPSVSAGSDGVSLSVPYYFNLAPNFDATFAPGIIGERGATFDGQIRYLRPDYSGQTDLTWLPHDKKSGRNNRYQAKWQHRHDISDTLQAGVDFNQVSDSGYYRDFYGGEEIAGNVNLNRRVWLDYGGRAAGGSLNAGLSVQKYQTLANQSGYKDEPYAIMPRLSADWHKNAGRAQIGVSAQFTRFSHDGRQDGSRLVVYPGIKWDFSNSWGYVRPKLGLHATYYSLDSFGGKASRSVGRVLPVVNIDGGTTFERNTRLFGGGVVQTIEPRLFYNYIPAKSQNDLPNFDSSESSFGYGQLFRENLYYGNDRINAANSLSTAVQSRILDGATGEERFRAGIGQKFYFKDDAVMLDGSVGKNPRSRSDWVAFASGGIGGRFTLDSSIHYNQNDKRAEHYAVGAGYRPAPGKVLNARYKYGRNEKIYLQADGSYFYDKLSQLDLSAQWPLTRNLSAVVRYNYGFEAKKPIEMLAGAEYKSSCGCWGAGVYAQRYVTGENTYKNAVFFSLQLKDLSSVGRNPAGRMDVAVPGYIPAHSLSAGRNKRP

SEQ ID NO: 2931 - DNA, 2409 bp, Neisseria meningitidis
ttggctcgtttattttcactcaaaccactggtgctggcattgggcctctgcttcggcacgcattgcgccgccgccgatgccgttgcggcggaggaaacggacaatccgaccgccggagaaagcgttcggagcgtgtccgaacccatacagcctaccagcctgagcctcggttcgacctgcctgttttgcagtaacgaaagcggcagccccgagagaaccgaagccgccgtccaaggcagcggcgaagcatccatccccgaagactatacgcgcattgttgccgacaggatggaaggacagtcgcaggtgcaggtgcgtgccgaaggcaacgtcgtcgtcgaacgcaaccggacgaccctcaataccgattgggcggattacgaccagtcgggcgacaccgttaccgcaggcgaccggttcgccctccaacaggacggtacgctgattcggggcgaaaccctgacctacaatctcgagcagcagaccggggaagcgcacaacgtccgcatggaaatcgaacaaggcggacggcggctgcaaagcgtcagccgcaccgccgaaatgttgggcgaagggcattacaaactgacggaaacccaattcaacacctgttccgccggcgatgccggctggtatgtcaaggcagcctctgtcgaagccgatcgggaaaaaggcataggcgttgccaaacacgccgccttcgtgttcggcggcgttcccattttctacaccccttgggcggacttcccgcttgacggcaaccgcaaaagcggcctgcttgttccctcactgtccgccggttcggacggcgtttccctttccgttccctattatttcaaccttgcccccaatctcgatgccacgttcgcgcccagcgtgatcggcgaacgcggcgcggtctttgacgggcaggtacgctacctgcggccggattatgccggccagtccgacctgacctggctgccgcacgacaagaaaagcggcaggaataaccgctatcaggcgaaatggcagcatcggcacgacatttccgacacgcttcaggcgggtgtcgatttcaaccaagtctccgacagcggctactaccgcgacttttacggcaacaaagaaatcgccggcaacgtcaacctcaaccgccgtgtatggctggattatggcggcagggcggcgggcggcagcctgaatgccggcctttcggttctgaaataccagacgctggcaaaccaaagcggctacaaagacaaaccgtatgccctcatgccgcgcctttcggtcgagtggcgtaaaaacaccggcagggcgcaaatcggcgtgtccgcacaatttacccgattcagccacgacagccgccaagacggcagccgcctggtcgtctatcccgacatcaaatgggatttcagcaacagctggggctatgtccgtcccaaactcggactgcacgccacctattacagcctcaaccgcttcggcagccaagaagcccgacgcgtcagccgcactctgcccattgtcaacatcgacagcggcgcaacttttgagcggaatacgcggatgttcggcggagaagtcctgcaaaccctcgagccgcgcctgttctacaactatattcctgccaaatcccaaaacgacctgcccaatttcgattcgtcggaaagcagcttcggctacgggcagctctttcgcgaaaacctctattacggcaacgacaggattaacaccgcaaacagcctttccgccgccgtgcaaagccgtattttggacggcgcgacgggggaagagcgtttccgcgccggcatcggtcagaaattctatttcaaggatgatgcggtgatgcttgacggcagcgtcggcaaaaaaccgcgcaaccgttccgactgggtggcatttgcctccggcagcatcggcagccgcttcatcctcgacagcagcatccactacaaccaaaacgacaaacgcgccgagaactacgccgtcggtgcaagctaccgtcccgcacagggcaaagtgctgaacgcccgctacaaatacgggcgcaacgaaaaaatctacctgaagtccgacggttcctatttttacgacaaactcagccagctcgacctgtccgcacaatggccgctgacgcgcaacctgtcggccgtcgtccgttacaactacggttttgaagccaaaaaaccgatagaggtgctggcgggtgcggaatacaaaagcagttgcggctgctggggcgcgggcgtgtacgcccaacgctacgttaccggcgaaaacacctacaaaaacgctgtctttttctcacttcagttgaaagacctcagcagtgtcggcagaaaccccgcagacaggatggatgtcgccgttcccggctatatcaccgcccactctctttccgccggacgcaacaaacgaccctga

SEQ ID NO: 2932 - protein, 802 aa, Neisseria meningitidis
LARLFSLKPLVLALGLCFGTHCAAADAVAAEETDNPTAGESVRSVSEPIQPTSLSLGSTCLFCSNESGSPERTEAAVQGSGEASIPEDYTRIVADRMEGQSQVQVRAEGNVVVERNRTTLNTDWADYDQSGDTVTAGDRFALQQDGTLIRGETLTYNLEQQTGEAHNVRMEIEQGGRRLQSVSRTAEMLGEGHYKLTETQFNTCSAGDAGWYVKAASVEADREKGIGVAKHAAFVFGGVPIFYTPWADFPLDGNRKSGLLVPSLSAGSDGVSLSVPYYFNLAPNLDATFAPSVIGERGAVFDGQVRYLRPDYAGQSDLTWLPHDKKSGRNNRYQAKWQHRHDISDTLQAGVDFNQVSDSGYYRDFYGNKEIAGNVNLNRRVWLDYGGRAAGGSLNAGLSVLKYQTLANQSGYKDKPYALMPRLSVEWRKNTGRAQIGVSAQFTRFSHDSRQDGSRLVVYPDIKWDFSNSWGYVRPKLGLHATYYSLNRFGSQEARRVSRTLPIVNIDSGATFERNTRMFGGEVLQTLEPRLFYNYIPAKSQNDLPNFDSSESSFGYGQLFRENLYYGNDRINTANSLSAAVQSRILDGATGEERFRAGIGQKFYFKDDAVMLDGSVGKKPRNRSDWVAFASGSIGSRFILDSSIHYNQNDKRAENYAVGASYRPAQGKVLNARYKYGRNEKIYLKSDGSYFYDKLSQLDLSAQWPLTRNLSAVVRYNYGFEAKKPIEVLAGAEYKSSCGCWGAGVYAQRYVTGENTYKNAVFFSLQLKDLSSVGRNPADRMDVAVPGYITAHSLSAGRNKRP

SEQ ID NO: 2933 - DNA, 2409 bp, Neisseria meningitidis
ttggctcgtttattttcactcaaaccactggtgctggcattgggcttctgtttcggcacgcattgcgccgccgccgatgccgttgcggcggaggaaacggacaatccgaccgccggaggaagcgttcggagcgtgtccgaacccatacagcctaccagcctgagcctcggttcgacctgcctgttttgcagtaacgaaagcggcagccccgagagaaccgaagccgccgtccaaggcagcggcgaagcatccatccccgaagactatacgcgcattgttgccgacaggatggaaggacagtcgcaggtgcaggtgcgtgccgaaggcaacgtcgtcgtcgaacgcaatcggacgaccctcaatgccgattgggcggattacgaccagtcgggcgacaccgttaccgcaggcgaccggttcgccctccaacaggacggtacgctgattcggggcgaaaccctgacctacaatctcgagcagcagaccggggaagcgcacaacgtccgtatggaaaccgaacacggcggacggcggctgcaaagcgtcagccgcaccgccgaaatgttgggcgaagggcattacaaactgacggaaacccaattcaacacctgttccgccggcgatgccggctggtatgtcaaggccgcttccgtcgaagccgatcgggaaaaaggcataggcgttgccaaacacgccgccttcgtgttcggcggcgttcccattttctacaccccttgggcggacttcccgcttgacggcaaccgcaaaagcggcctgctcgttccctcactgtccgccggttcggacggcgtttccctttccgttccctattatttcaaccttgcccccaatctcgatgccacgttcgcgcccggcgtgatcggcgaacgcggcgcggtctttgacgggcaggtacgctacctgcggccggattatgccggccagtccgacctgacctggctgccgcacgacaagaaaagcggcaggaataaccgctatcaggcgaaatggcagcaccggcacgacatttccgacacgcttcaggcgggtgtcgatttcaaccaagtctccgacagcggctactaccgcgacttttacggcaacaaagaaatcgccggcaacgtcaacctcaaccgccgtgtatggctggattatggcggcagggcggcgggcggcagcctgaatgccggcctttcggttctgaaataccagacgctggcaaaccaaagcggctacaaagacaaaccgtatgccctgatgccgcgcctttccgccgattggcgcaaaaacaccggcagggcgcaaatcggcgtgtccgcccaatttacccgcttcagccacgacagccgccaagacggcagccgcctcgtcgtctatcccgacatcaaatgggatttcagcaacagctggggttacgtccgtcccaaactcggactgcacgccacctattacagcctcaaccgcttcggcagccaagaagcccgacgcgtcagccgcactctgcccatcgtcaacatcgacagcggcatgaccttcgaacgcaatacgcggatgttcggcggcggagtcctgcaaaccctcgagccgcgcctgttctacaactatattcctgccaaatcccaaaacgacctgcccaatttcgattcgtcggaaagcagcttcggctacgggcagctttttcgtgaaaacctctattacggcaacgacaggattaacaccgcaaacagcctttccgccgccgtgcaaagccgtattttggacggcgcgacgggggaagagcgtttccgcgccggcatcgggcagaaattctacttcaaaaacgacgcagtcatgcttgacggcagtgtcggcaaaaaaccgcgcagccgttccgactgggtggcattcgcctccagcggcatcggcagccgcttcatcctcgacagcagcatccactacaaccaaaacgacaaacgcgccgagaactacgccgtcggtgcaagctaccgtcccgcacagggcaaagtgctgaacgcccgctacaaatacgggcgcaacgaaaaaatctacctgaagtccgacggttcctatttttacgacaaactcagccagctcgacctgtccgcacaatggccgctgacgcgcaacctgtcggccgtcgtccgttacaactacggttttgaagccaaaaaaccgatagaggtgctggcgggtgcggaatacaaaagcagttgcggctgctggggcgcgggcgtgtacgcccaacgctacgttaccggcgaaaacacctacaaaaacgctgtctttttctcacttcagttgaaagacctcagcagtgtcggcagaaaccccgcagacaggatggatgtcgccgttcccggctatatccccgcccactctctttccgccggacgcaacaaacggccctga

SEQ ID NO: 2934 - protein, 802 aa, Neisseria meningitidis
LARLFSLKPLVLALGFCFGTHCAAADAVAAEETDNPTAGGSVRSVSEPIQPTSLSLGSTCLFCSNESGSPERTEAAVQGSGEASIPEDYTRIVADRMEGQSQVQVRAEGNVVVERNRTTLNADWADYDQSGDTVTAGDRFALQQDGTLIRGETLTYNLEQQTGEAHNVRMETEHGGRRLQSVSRTAEMLGEGHYKLTETQFNTCSAGDAGWYVKAASVEADREKGIGVAKHAAFVFGGVPIFYTPWADFPLDGNRKSGLLVPSLSAGSDGVSLSVPYYFNLAPNLDATFAPGVIGERGAVFDGQVRYLRPDYAGQSDLTWLPHDKKSGRNNRYQAKWQHRHDISDTLQAGVDFNQVSDSGYYRDFYGNKEIAGNVNLNRRVWLDYGGRAAGGSLNAGLSVLKYQTLANQSGYKDKPYALMPRLSADWRKNTGRAQIGVSAQFTRFSHDSRQDGSRLVVYPDIKWDFSNSWGYVRPKLGLHATYYSLNRFGSQEARRVSRTLPIVNIDSGMTFERNTRMFGGGVLQTLEPRLFYNYIPAKSQNDLPNFDSSESSFGYGQLFRENLYYGNDRINTANSLSAAVQSRILDGATGEERFRAGIGQKFYFKNDAVMLDGSVGKKPRSRSDWVAFASSGIGSRFILDSSIHYNQNDKRAENYAVGASYRPAQGKVLNARYKYGRNEKIYLKSDGSYFYDKLSQLDLSAQWPLTRNLSAVVRYNYGFEAKKPIEVLAGAEYKSSCGCWGAGVYAQRYVTGENTYKNAVFFSLQLKDLSSVGRNPADRMDVAVPGYIPAHSLSAGRNKRP

SEQ ID NO: 2935 - DNA, 327 bp, Neisseria gonorrhoeae; identical to SEQ ID NO: 2509

SEQ ID NO: 2936 - protein, 108 aa, Neisseria gonorrhoeae; identical to SEQ ID NO: 2510

SEQ ID NO: 2937 - DNA, 327 bp, Neisseria meningitidis; identical to SEQ ID NO: 2511

SEQ ID NO: 2938 - protein, 108 aa, Neisseria meningitidis; identical to SEQ ID NO: 2512

SEQ ID NO: 2939 - DNA, 327 bp, Neisseria meningitidis; identical to SEQ ID NO: 2513

SEQ ID NO: 2940 - protein, 108 aa, Neisseria meningitidis; identical to SEQ ID NO: 2514

SEQ ID NO: 2941 - DNA, 1623 bp, Neisseria meningitidis
atgcaagtaaatattcagattccctgtatgctgtacagacgcgggagtgttaagccccccttgtttgaagctccgcggctcctgccgagcttcaccgaccccgttgtgcccaagctctctgctcccggcggctacattgtcgacatccccaaaggcaatctgaaaaccgaaatcgaaaagctggccaaacagcccgagtatgcctatctgaaacagctccaagtagcgaaaaacgtcaactggaaccaggtgcaactggcttacgataaatgggactataagcaggaaggcttaaccagagccggtgcagcgattatcgcgctggctgttaccgtggttactgcgggcgcgggagtcggagccgcactaggcttaaacggcgcagccgcagcagcggccgatgccgcctttgcctcactcgcttctcaggcttccgtatcgctcatcaacaataaaggcgatgtcggcaaaaccctgaaggaactgggcagaagccgcacggtaaaaaatctggttgtagcggcggcaacggcaggcgtatccaacaaactcggtgcctcttcccttgccacttggagcgaaaccccttgggtaaacaacctcaacgttaacctggccaatgcgggcagtgccgcgctgatcaacaccgctgttaacggcggcagcctgaaagacaatctggaggcaaatatcctggcggcattggtgaataccgcgcatggggaggcggcgagtaagatcaaaggactggatcagcactatgtcgcccacaaaatcgctcatgccgtagcgggctgtgcggctgcagcggcgaataagggcaaatgtcaggacggcgcgatcggtgcggctgtgggtgagattgtcggggaggctttggttaaaaataccgattttagcgatatgaccccggaacaattagatctggaagttaagaaaattaccgcctatgccaaacttgcggcaggtacagttgcaggcgtaacgggaggagatgtcaatactgctgcacaaaccgcacaaaacgcggtagaaaataatgcggttaaagctgttgtaactgctgcaaaagtggtttataaggtagccagaaaaggattaaaaaacgggaaaatcaacgttagagatttaaaacagacgttgaaagacgaaggttataatttagccgacaacctgaccaccttattcgacgaaacattggattggaacgatgccaaagccgttattgatattgtcgtcggaacagagctgaatcgcgctaataaaggggaagcggcacaaaaggtcaaggaagttttagaaaaaaatcgtccttatatccctaataaaggtgctgtaccgaatatgagtacatacatgaaaaataatccttttggaaaacagctggctcaaatttcagaaaagacaacgcttccgacgcagcaagggcagtctgtcttcttggtaaaaagaaaccaagggttattaaaaaccggtgataggttttatttagatggccaacataaaaatcatttagaggtttttgataaaaatgggaactttaagtttgttctaaatatggatggttcgcttaaccaaatgaaaactggggcagcaaaaggtcgtaaattaaacttaaaatag

SEQ ID NO: 2942 - protein, 540 aa, Neisseria meningitidis
MQVNIQIPCMLYRRGSVKPPLFEAPRLLPSFTDPVVPKLSAPGGYIVDIPKGNLKTEIEKLAKQPEYAYLKQLQVAKNVNWNQVQLAYDKWDYKQEGLTRAGAAIIALAVTVVTAGAGVGAALGLNGAAAAAADAAFASLASQASVSLINNKGDVGKTLKELGRSRTVKNLVVAAATAGVSNKLGASSLATWSETPWVNNLNVNLANAGSAALINTAVNGGSLKDNLEANILAALVNTAHGEAASKIKGLDQHYVAHKIAHAVAGCAAAAANKGKCQDGAIGAAVGEIVGEALVKNTDFSDMTPEQLDLEVKKITAYAKLAAGTVAGVTGGDVNTAAQTAQNAVENNAVKAVVTAAKVVYKVARKGLKNGKINVRDLKQTLKDEGYNLADNLTTLFDETLDWNDAKAVIDIVVGTELNRANKGEAAQKVKEVLEKNRPYIPNKGAVPNMSTYMKNNPFGKQLAQISEKTTLPTQQGQSVFLVKRNQGLLKTGDRFYLDGQHKNHLEVFDKNGNFKFVLNMDGSLNQMKTGAAKGRKLNLK

SEQ ID NO: 2943 - DNA, 1095 bp, Neisseria meningitidis
atgagcatgaaacactttccagccaaagtactgaccacagccatccttgccactttctgtagcggcgcactggcagccacaagcgacgacgatgttaaaaaagctgccactgtggccattgttgctgcctacaacaatggccaagaaatcaacggtttcaaagctggagagaccatctacgacattggtgaagacggcacaattacccaaaaagacgcaactgcagccgatgttgaagccgacgactttaaaggtctgggtctgaaaaaagtcgtgactaacctgaccaaaaccgtcaatgaaaacaaacaaaacgtcgatgccaaagtaaaagctgcagaatctgaaatagaaaagttaacaaccaagttagcagacactgatgccgctttagcagatactgatgccgctctggatgaaaccaccaacgccttgaataaattgggagaaaatataacgacatttgctgaagagactaagacaaatatcgtaaaaattgatgaaaaattagaagccgtggctgataccgtcgacaagcatgccgaagcattcaacgatatcgccgattcattggatgaaaccaacactaaggcagacgaagccgtcaaaaccgccaatgaagccaaacagacggccgaagaaaccaaacaaaacgtcgatgccaaagtaaaagctgcagaaactgcagcaggcaaagccgaagctgccgctggcacagctaatactgcagccgacaaggccgaagctgtcgctgcaaaagttaccgacatcaaagctgatatcgctacgaacaaagctgatattgctaaaaactcagcacgcatcgacagcttggacaaaaacgtagctaatctgcgcaaagaaacccgccaaggccttgcagaacaagccgcgctctccggcctgttccaaccttacaacgtgggtcggttcaatgtaacggctgcagtcggcggctacaaatccgaatcggcagtcgccatcggtaccggcttccgctttaccgaaaactttgccgccaaagcaggcgtggcagtcggcacttcgtccggttcttccgcagcctaccatgtcggcgtcaattacgagtggtaa

SEQ ID NO: 2944 - protein, 364 aa, Neisseria meningitidis
MSMKHFPAKVLTTAILATFCSGALAATSDDDVKKAATVAIVAAYNNGQEINGFKAGETIYDIGEDGTITQKDATAADVEADDFKGLGLKKVVTNLTKTVNENKQNVDAKVKAAESEIEKLTTKLADTDAALADTDAALDETTNALNKLGENITTFAEETKTNIVKIDEKLEAVADTVDKHAEAFNDIADSLDETNTKADEAVKTANEAKQTAEETKQNVDAKVKAAETAAGKAEAAAGTANTAADKAEAVAAKVTDIKADIATNKADIAKNSARIDSLDKNVANLRKETRQGLAEQAALSGLFQPYNVGRFNVTAAVGGYKSESAVAIGTGFRFTENFAAKAGVAVGTSSGSSAAYHVGVNYEW

SEQ ID NO: 2945 - DNA, 1269 bp, Neisseria meningitidis
ttgactaacagggggggagcgaaattaaaaaccarttccaagagtagtgaacgaatgagtgaagttgaatatttctcacactttatatcggacggaaaagggaagcttttagaaattccgcagcgaagaggtaagcaagacggggtttttgttgattggatttcattcacattccatgaagatactttactgaaagtttccggttgccctttattttctgatgctgaatacatgtatgtattaagcagaaagctggaagaaattctaggttttggcataacgcgcaaatgcaaatcaaggggcaacaaattctatgaatccatgtataggttaggttcggatgatgttgattatggagaggtgcatttcggargtcagcgcaatactgttttagttgagttgaaaggtactggttgcagcgttgcaagtccgggttgggagttgaggctaaagcagtttctcgatgattcgataaggacaagaataacgcgaattgacctagcacttgatttttttgatggagagtacacgccggatcaggcgttgttagatcacgataatggtttttttgataacagcaatcaaaggccgaaatctgaaacgatcggtacggcttggcggaatgaggacgggagcggcaagacattttatgtaggtcgcaagaaaaattctcgttttgttcgtgtttatgagaaaggcaggcagcttggagataaagaaagcaaatgggtaaggttcgagatccagtttaattatggagatatagaaatacccttggatattttaataaatcagggttcgtatttctgtggagcttttccaatttgtagaaaatttaaaaatatgccggttcccgaaaggtttgatcagagaaagaaaaagcttaatttaactttcgagcataaattgcattacgcgaaaaacgcggttggaaaactggtcaatttcatgattgaaatgggttttgataatagcgaaattgtggaatctttaaaggcagattcgggatttcccaaaggattagaacctgaaaaatatgctctggaaatgttaagggacggtttgaaacacggttttattcatgaacagccggatattgatttggaaattgaacttgatgaattgggggttattgcttttaaaaattctgacaaattcgatagggaaaaaaggctttttagtcctgattatgatgtcgagaaagaaaggaaatatcaggaatatttaagtaaagtttatcatcaaaatgtagattatgattatttttaa

SEQ ID NO: 2946 - protein, 422 aa, Neisseria meningitidis
  misc_feature (12)..(12): Xaa can be any naturally occurring amino acid
  misc_feature (125)..(125): Xaa can be any naturally occurring amino acid
LTNRGGAKLKTXSKSSERMSEVEYFSHFISDGKGKLLEIPQRRGKQDGVFVDWISFTFHEDTLLKVSGCPLFSDAEYMYVLSRKLEEILGFGITRKCKSRGNKFYESMYRLGSDDVDYGEVHFGXQRNTVLVELKGTGCSVASPGWELRLKQFLDDSIRTRITRIDLALDFFDGEYTPDQALLDHDNGFFDNSNQRPKSETIGTAWRNEDGSGKTFYVGRKKNSRFVRVYEKGRQLGDKESKWVRFEIQFNYGDIEIPLDILINQGSYFCGAFPICRKFKNMPVPERFDQRKKKLNLTFEHKLHYAKNAVGKLVNFMIEMGFDNSEIVESLKADSGFPKGLEPEKYALEMLRDGLKHGFIHEQPDIDLEIELDELGVIAFKNSDKFDREKRLFSPDYDVEKERKYQEYLSKVYHQNVDYDYF

SEQ ID NO: 2947 - DNA, 1269 bp, Neisseria meningitidis
ttgactaacagggggggagcgaaattaaaaaccaattccaagagtagtgaacgaatgagtgaagttgaatatttctcacactttatatcggacggaaaagggaagcttttagaaattccgcagcgaagaggtaagcaagacggggtttttgttgattggatttcattcacattccatgaagatactttactgaaagtttccggttgccctttattttctgatgctgaatacatgtatgtattaagcagaaagctggaagaaattctaggttttggcataacgcgcaaatgcaaatcaaggggcaacaaattctatgaatccatgtataggttaggttcggatgatgttgattatggagaggtgcatttcggaggtcagcgcaatactgttttagttgagttgaaaggtactggttgcagcgttgcaagtccgggttgggagttgaggctaaagcagtttctcgatgattcgataaggacaagaataacgcgaattgacctagcacttgatttttttgatggagagtacacgccggatcaggcgttgttagatcacgataatggtttttttgataacagcaatcaaaggccgaaatctgaaacgatcggtacggcttggcggaatgaggacgggagcggcaagacattttatgtaggtcgcaagaaaaattctcgttttgttcgtgtttatgagaaaggcaggcagcttggagataaagaaagcaaatgggtaaggttcgagatccagtttaattatggagatatagaaatacccttggatattttaataaatcagggttcgtatttctgtggagcttttccaatttgtagaaaatttaaaaatatgccggttcccgaaaggtttgatcagagaaagaaaacgcttaatttaactttcgagcataaattgcattacgcgaaaaacgcggttggaaaactggtcaatttcatgattgaaatgggttttgataatagcgaaattgtggaatctttaaaggcagattcgggatttcccaaaggattagaacctgaaaaatatgctctggaaatgttaagggacggtttgaaacacggttttattcatgaacagccggatattgatttggaaattgaacttgatgaattgggggttattgcttttaaaaattctgacaaattcgatagggaaaaaaggctttttagtcctgattatgatgtcgagaaagaaaggaaatatcaggaatatttaagtaaagtttatcatcaaaatgtagattatgattatttttaa

SEQ ID NO: 2948 - protein, 422 aa, Neisseria meningitidis
LTNRGGAKLKTNSKSSERMSEVEYFSHFISDGKGKLLEIPQRRGKQDGVFVDWISFTFHEDTLLKVSGCPLFSDAEYMYVLSRKLEEILGFGITRKCKSRGNKFYESMYRLGSDDVDYGEVHFGGQRNTVLVELKGTGCSVASPGWELRLKQFLDDSIRTRITRIDLALDFFDGEYTPDQALLDHDNGFFDNSNQRPKSETIGTAWRNEDGSGKTFYVGRKKNSRFVRVYEKGRQLGDKESKWVRFEIQFNYGDIEIPLDILINQGSYFCGAFPICRKFKNMPVPERFDQRKKTLNLTFEHKLHYAKNAVGKLVNFMIEMGFDNSEIVESLKADSGFPKGLEPEKYALEMLRDGLKHGFIHEQPDIDLEIELDELGVIAFKNSDKFDREKRLFSPDYDVEKERKYQEYLSKVYHQNVDYDYF

SEQ ID NO: 2949 - DNA, 863 bp, Neisseria gonorrhoeae
atggacggcgcacaaccgaaaacaaatttttttgaacgcctgattgcccgactcgcccgcgaacccgattccgccgaagacgtattaaacctgcttcggcaggcgcacgaacaggaagtttttgatgccgacacactgacccggctggaaaaagtattggactttgccgagctggaagtgcgcgatgcgatgattacgcgcagccgcatgaacgtattgaaagaaaacgacagcatcgaacgcatcaccgcctacgtcatcgataccgcccattcgcgcttccccgtcatcggcgaagacaaagacgaagttttgggcattttgcacgccaaagacctgctcaaatatatgttcaaccccgagcagttccacctgaaatccgtcttgcgccctgccgttttcgtgcccgaaggcaaatctttgaccgcccttttaaaagagttccgcgaacagcgcaaccatatggcaatcgtcatcgacgaatacggcggcacgtcgggtttggtcacctttgaagacatcatcgagcaaatcgtcggtgacatcgaagacgagtttgacgaagacgaaagcgccgacgacatccactccgtttccgccgaacgctggcgcatccacgcggctaccgaaatcgaagacatcaacgcctttttcggtacggaatacggcagcgaagaagccgacaccatcggcggcttggtcattcaggaattgggacacctgcccgtgcgcggcgaaaaagtccttatcggcggtttgcagttcaccgtcgcccgcgccgacaaccgccgcctgcacacgctgatggcgacccgcgtgaagtaagcagagcctgcccgcaccgccgtttctgcacagtttag

SEQ ID NO: 2950 - protein, 274 aa, Neisseria gonorrhoeae
MDGAQPKTNFFERLIARLAREPDSAEDVLNLLRQAHEQEVFDADTLTRLEKVLDFAELEVRDAMITRSRMNVLKENDSIERITAYVIDTAHSRFPVIGEDKDEVLGILHAKDLLKYMFNPEQFHLKSVLRPAVFVPEGKSLTALLKEFREQRNHMAIVIDEYGGTSGLVTFEDIIEQIVGDIEDEFDEDESADDIHSVSAERWRIHAATEIEDINAFFGTEYGSEEADTIGGLVIQELGHLPVRGEKVLIGGLQFTVARADNRRLHTLMATRVK

SEQ ID NO: 2951 - DNA, 825 bp, Neisseria meningitidis
atggacggcgcacaaccgaaaacgaatttttttgaacgcctgattgcccgactcgcccgcgaacccgattccgccgaagacgtattaaacctgcttcggcaggcgcacgagcaggaagtttttgatgcggatacgcttttaagattggaaaaagtcctcgatttttccgatttggaagtgcgcgacgcgatgattacgcgcagccgtatgaacgttttaaaagaaaacgacagcatcgagcgcatcaccgcctacgttatcgataccgcccattcgcgcttccccgtcatcggcgaagacaaagacgaagttttgggcattttgcacgccaaagacctgctcaaatatatgtttaaccccgagcagttccacctcaaatccattctccgccccgccgtcttcgtccccgaaggcaaatcgctgaccgcccttttaaaagagttccgcgaacagcgcaaccatatggcgattgtcatcgacgaatacggcggcacatccggcttggtcacctttgaagacatcatcgagcaaatcgtcggcgaaatcgaagacgagtttgacgaagacgatagcgccgacaatatccatgccgtttcttcmgaacgctggcgcatccatgcagctaccgaaatcgaagacatcaacaccttcttcggcacggaatacagcakcgaagaagccgacaccattggcggcctggtcattcaagagttgggacatctgcccgtgcgcggcgaaaaagtccttatcggcggtttgcagttcaccgtcgcacgcgccgacaaccgccgcctgcatacgctgatggcgacccgcgtgaagtaa

SEQ ID NO: 2952 - protein, 274 aa, Neisseria meningitidis
  misc_feature (224)..(224): Xaa can be any naturally occurring amino acid
MDGAQPKTNFFERLIARLAREPDSAEDVLNLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGEIEDEFDEDDSADNIHAVSSERWRIHAATEIEDINTFFGTEYSXEEADTIGGLVIQELGHLPVRGEKVLIGGLQFTVARADNRRLHTLMATRVK

SEQ ID NO: 2953 - DNA, 825 bp, Neisseria meningitidis
atggacggcgcacaaccgaaaacaaatttttttgaacgcctgattgcccgactcgcccgcgaacccgattccgccgaagacgtattgaccctgttgcgccaagcgcacgaacaggaagtatttgatgcggatacgcttttaagattggaaaaagtcctcgatttttctgatttggaagtgcgcgacgcgatgattacgcgcagccgtatgaacgttttaaaagaaaacgacagcatcgaacgcatcaccgcctacgttatcgataccgcccattcgcgcttccccgtcatcggtgaagacaaagacgaagttttgggtattttgcacgccaaagacctgctcaaatatatgttcaaccccgagcagttccacctcaaatcgatattgcgccctgccgtcttcgtccccgaaggcaaatcgctgaccgcccttttaaaagagttccgcgaacagcgcaaccatatggcaatcgtcatcgacgaatacggcggcacgtcgggtttggtaacttttgaagacatcatcgagcaaatcgtcggcgacatcgaagatgagtttgacgaagacgaaagcgcggacaacatccacgccgtttccgccgaacgctggcgcatccacgcggctaccgaaatcgaagacatcaacgcctttttcggcacggaatacagcagcgaagaagccgacaccatcggcggcctggtcattcaggaattgggacacctgcccgtgcgcggcgaaaaagtccttatcggcggtttgcagttcaccgtcgcccgcgccgacaaccgccgcctgcatacgctgatggcgacccgcgtgaagtaa

SEQ ID NO: 2954 - protein, 274 aa, Neisseria meningitidis
MDGAQPKTNFFERLIARLAREPDSAEDVLTLLRQAHEQEVFDADTLLRLEKVLDFSDLEVRDAMITRSRMNVLKENDSIERITAYVIDTAHSRFPVIGEDKDEVLGILHAKDLLKYMFNPEQFHLKSILRPAVFVPEGKSLTALLKEFREQRNHMAIVIDEYGGTSGLVTFEDIIEQIVGDIEDEFDEDESADNIHAVSAERWRIHAATEIEDINAFFGTEYSSEEADTIGGLVIQELGHLPVRGEKVLIGGLQFTVARADNRRLHTLMATRVK

SEQ ID NO: 2955 - DNA, 801 bp, Neisseria gonorrhoeae
atgaaaaaatggattgccgccgcccttgcctgttccgcactcgcgctgtctgcctgcggcggtcagggcaaagatgccgccgcgcctgccgccaaccccggcaaagtgtaccgcgtggcttccaacgccgagtttgccccctttgaatctttagactcgaaaggcaatgtcgaaggtttcgacgtggatttgatgaacgcgatggcgaaggcgggcaattttaaaatcgaattcaaacaccagccgtgggacagccttttccccgccttgaacaacggcgatgcggacgttgtgatgtcgggcgtaaccattaccgacgaccgcaaacagtctatggatttcagcgacccgtattttgaaatcacccaagtcgtcctcgttccgaaaggcaaaaaagtatcttcttccgaagatttgaaaaagatgaacaaagtcggcgtggttaccggccacacgggcgatttctccgtttccaaactcttgggcaacgacaatccgaaaatcgcgcgcttcgaaaacgtccccctgattatcaaagaactggaaaacggcggcttggattccgtggtcagcgacagcgcggtcatcgccaattatgtgaaaaacaacccggccaaaggaatggacttcgttaccctgcccgacttcaccaccgaacactacggcatcgcggtacgcaaaggcgacgaagcaaccgtcaaaatgctgaacgatgcgttggaaaaagtacgcgaaagcggcgaatacgacaagatctacgccaaatattttgccaaagagggcggacaggctgcgaaataa

SEQ ID NO: 2956 - protein, 266 aa, Neisseria gonorrhoeae
MKKWIAAALACSALALSACGGQGKDAAAPAANPGKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKVSSSEDLKKMNKVGVVTGHTGDFSVSKLLGNDNPKIARFENVPLIIKELENGGLDSVVSDSAVIANYVKNNPAKGMDFVTLPDFTTEHYGIAVRKGDEATVKMLNDALEKVRESGEYDKIYAKYFAKEGGQAAK

SEQ ID NO: 2957 - DNA, 801 bp, Neisseria meningitidis
atgaaaaaatggattgccgccgcccttgcctgttccgcgctcgcgctgtctgcctgcggcggtcagggcaaagataccgccgcgcctgccgccaaccccgacaaagtgtaccgcgtggcttccaacgccgagtttgccccctttgaatctttagactcgaaaggcaatgtcgaaggtttcgatgtggatttgatgaacgcgatggcgaaggcgggcaattttaaaatcgaattcaaacaccagccgtgggacagccttttccccgccttaaacaacggcgatgcggacgttgtgatgtcgggcgtaaccattaccgacgaccgcaaacagtctatggacttcagcgacccgtattttgaaatcacccaagtcgtcctcgttccgaaaggcaaaaaagtatcttcttccgaagatttgaaaaacatgaacaaagtcggcgtggtaaccggctacacgggcgatttctccgtatccaaactcttgggcaacgacaatccgaaaatcgcgcgctttgaaaacgttcccctgattatcaaagaactggaaaacggcggcttggattccgtggtcagcgacagcgcggtcatcgccaattatgtgaaaaacaatccggccaaagggatggacttcgttaccctgcccgacttcaccaccgaacactacggcatcgcggtacgcaaaggcgacgaagcaaccgtcaaaatgctgaacgatgcgttggaaaaagtacgcgaaagcggcgaatacgacaagatttacgccaaatattttgcaaaagaagacggacaggccgcaaaataa

SEQ ID NO: 2958 - protein, 266 aa, Neisseria meningitidis
MKKWIAAALACSALALSACGGQGKDTAAPAANPDKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKVSSSEDLKNMNKVGVVTGYTGDFSVSKLLGNDNPKIARFENVPLIIKELENGGLDSVVSDSAVIANYVKNNPAKGMDFVTLPDFTTEHYGIAVRKGDEATVKMLNDALEKVRESGEYDKIYAKYFAKEDGQAAK

SEQ ID NO: 2959 - DNA, 801 bp, Neisseria meningitidis
atgaaaaaatggattgccgccgcccttgcctgttccgcgctcgcgctgtctgcctgcggcggtcagggtaaagatgccgccgcgcccgccgcaaatcccgacaaagtgtaccgcgtggcttccaacgccgagtttgccccctttgaatctttagactcgaaaggcaatgtcgaaggtttcgatgtggatttgatgaacgcgatggcgaaggcgggcaattttaaaatcgaattcaaacaccagccgtgggacagccttttccccgccttgaacaacggcgatgcggacgttgtgatgtcgggcgtaaccattaccgacgaccgcaaacagtctatggacttcagcgacccgtattttgaaatcacccaagtcgtcctcgttccgaaaggcaaaaaaatatcttcttccgaagatttgaaaaacatgaacaaagtcggcgtggtaaccggctacacgggcgatttctccgtatccaaactcttgggcaacgacaacccgaaaatcgcgcgctttgaaaacgttcccctgattatcaaagaactggaaaacggcggcttggattccgtggtcagcgacagcgcagtcatcgccaattatgtgaaaaacaatccgaccaaagggatggacttcgttaccctgcccgacttcaccaccgaacactacggcatcgcggtacgcaaaggcgacgaagcaaccgtcaaaatgctgaacgatgcgttgaaaaaagtacgcgaaagcggcgaatacgacaaaatctacgccaaatattttgcaaaagaagacggacaggccgcaaaataa

SEQ ID NO: 2960 - protein, 266 aa, Neisseria meningitidis
MKKWIAAALACSALALSACGGQGKDAAAPAANPDKVYRVASNAEFAPFESLDSKGNVEGFDVDLMNAMAKAGNFKIEFKHQPWDSLFPALNNGDADVVMSGVTITDDRKQSMDFSDPYFEITQVVLVPKGKKISSSEDLKNMNKVGVVTGYTGDFSVSKLLGNDNPKIARFENVPLIIKELENGGLDSVVSDSAVIANYVKNNPTKGMDFVTLPDFTTEHYGIAVRKGDEATVKMLNDALKKVRESGEYDKIYAKYFAKEDGQAAK

SEQ ID NO: 2961 - DNA, 1635 bp, Neisseria gonorrhoeae
atcgcatcgcaaaaccttcgattcgacaatcgattcctccaaaaaatggtcaacggcgtgaatattttgccggccgccgattgggtagccttgggcgccaaaggccgcaacgtggtggttgaccgcgctttcggcggcccgcacatcaccaaagacggcgtaaccgtcgccaaagaaatcgaactgaaagacaagtttgaaaatatgggcgcgcaaatggtaaaagaagtcgcgtccaaaaccaacgacgtagccggcgacggtacgactaccgccaccgtattggcacaatccatcgttgccgaaggcatgaaatacgttaccgccggcatgaacccgaccgatctgaaacgcggcatcgacaaagccgttgccgctttggttgaagagctgaaaaacatcgccaaaccttgcgatacttccaaagaaatcgcccaagtcggctcgatttccgccaactccgacgaacaagtcggcgcgattatcgccgaagcgatggaaaaagtcggcaaagaaggcgtgattaccgttgaagacggcaaatctttggaaaacgagctggacgtggttgaaggtatgcagttcgaccgcggctacctgtccccttactttatcaacgacgcggaaaaacaaatcgccggtctggacaatccgtttgttttgctgttcgacaaaaaaatcagcaacatccgcgacctgctgcccgtgttggaacaagtggcgaaagccagccgcccgctgttgattatcgctgaagacgtagaaggcgaagccttggcgactttggtcgtgaacaacatccgcggcatcctgaaaaccgttgccgtcaaagcccccggcttcggcgaccgccgcaaagcgatgctgcaagacatcgccatcctgaccggcggcgtagtgatttccgaagaagtcggcctgtctttggaaaaagcgactttggacgacttgggtcaaaccaaacgcatcgaaatcggtgaagaaaacactaccgtcatcgacggcttcggcgacgcagcccaaatcgaagcgcgtgttgccgaaatccgccaacaaatcgaaaccgcgaccagcgattacgacaaagaaaaactgcaagagcgcgttgccaaactggcaggaggcgtggcagtgatcaaagtcggcgcggcgaccgaagtcgaaatgaaagagaaaaaagaccgcgtggaagacgcgctgcacgctacccgcgcagccgttgaagaaggcgtggttgcaggcggcggcgtagccctgttgcgcgcccgtgccgctttggaaaacctgcacaccggcaatgccgaccaagacgcaggcgtacaaatcgtattgcgcgccgttgagtctccgctgcgccaaatcgttgccaacgcaggcggagaacccagcgtggtggtgaacaaagtgttggaaggcaaaggcaactacggttacaacgcaggctccggcgaatacggcgacatgatcggaatgggcgtactcgaccctgccaaagtaacccgttccgcgctgcaacacgccgcgtctatcgccggtctgatgctgacgaccgactgcatgattgccgaaatccctgaagaaaaaccggctgtgcccgatatggggggaatgggcggtatgggcggcatgatgtaa

SEQ ID NO: 2962 - protein, 544 aa, Neisseria gonorrhoeae
IASQNLRFDNRFLQKMVNGVNILPAADWVALGAKGRNVVVDRAFGGPHITKDGVTVAKEIELKDKFENMGAQMVKEVASKTNDVAGDGTTTATVLAQSIVAEGMKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGILKTVAVKAPGFGDRRKAMLQDIAILTGGVVISEEVGLSLEKATLDDLGQTKRIEIGEENTTVIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIGMGVLDPAKVTRSALQHAASIAGLMLTTDCMIAEIPEEKPAVPDMGGMGGMGGMM

SEQ ID NO: 2963 - DNA, 1635 bp, Neisseria meningitidis
atggcagcaaaagacgtacagttcggcaatgaagtccgtcaaaaaatggtaaacggcgtgaacattctggcaaacgccgtccgcgtaaccttgggccccaaaggtcgcaacgtagtcgttgaccgcgcattcggcggcccgcacatcaccaaagacggcgtaaccgtcgccaaagaaatcgaactgaaagacaagtttgaaaatatgggcgcgcaaatggtgaaagaagttgcgtccaaaaccaacgacgtggcaggcgacggtacgactaccgccaccgtactggcgcaatccatcgttgccgaaggtatgaaatatgttaccgcaggtatgaatccgaccgacctgaaacgcggtatcgataaagccgtcgccgctttggttgacgaactgaaaaacatcgccaaaccttgcgacacttctaaagaaatcgcccaagtcggctctatttccgccaactccgacgaacaagtcggcgcgattatcgccgaagcgatggaaaaagtcggcaaagaaggcgtgattaccgttgaagacggcaagtctttggaaaacgagctggacgtagttgaaggtatgcagttcgaccgcggctacctgtctccttacttcatcaacgatgcggaaaaacaaatcgctgctttggacaatccgtttgtattgttgttcgacaaaaaaatcagcaacatccgcgacctgctgcctgttttggaacaagtggcaaaagccagccgtccgctgttgattatcgctgaagacgtagaaggcgaagccttggcgactttggtcgtgaacaacatccgaggcatcctgaaaaccgttgccgtcaaagcccctggcttcggcgaccgccgcaaagcgatgttgcaagacatcgccatcctgaccggcggcgtggtgatttccgaagaagtcggtctgtctttggaaaaagcgactttggacgacttgggtcaagccaaacgcatcgaaatcggtaaagaaaacaccaccatcatcgacggctttggcgacgcagcccaaatcgaagcgcgtgttgccgaaatccgccaacaaatcgaaaccgcaaccagcgattacgacaaagaaaaactgcaagagcgcgtggctaaattggcaggcggcgtggcagtcatcaaagtcggtgccgcgaccgaagtcgaaatgaaagagaaaaaagaccgcgtggaagacgcgctgcacgctacccgcgcagccgttgaagaaggcgtggttgcaggcggcggcgtagccctgttgcgtgcccgtgctgctttggaaaacctgcacaccggcaatgccgaccaagacgcaggcgtacaaatcgtcttgcgcgccgttgagtctccgctgcgccaaatcgttgccaacgcaggcggcgaacccagcgtggttgtgaacaaagtattggaaggcaaaggcaactacggttacaacgctggcagcggcgaatacggcgatatgatcgaaatgggcgtactcgaccccgccaaagtaacccgttctgcgctgcaacacgccgcatctatcgccggcttgatgctgaccactgattgcatgatcgctgaaatccccgaagacaaaccggctgtgcctgatatgggcggcatgggtggtatgggcggcatgatgtaa

SEQ ID NO: 2964 - protein, 1635 aa, Neisseria meningitidis
ATGGCAGCAAAAGACGTACAGTTCGGCAATGAAGTCCGTCAAAAAATGGTAAACGGCGTGAACATTCTGGCAAACGCCGTCCGCGTAACCTTGGGCCCCAAAGGTCGCAACGTAGTCGTTGACCGCGCATTCGGCGGCCCGCACATCACCAAAGACGGCGTAACCGTCGCCAAAGAAATCGAACTGAAAGACAAGTTTGAAAATATGGGCGCGCAAATGGTGAAAGAAGTTGCGTCCAAAACCAACGACGTGGCAGGCGACGGTACGACTACCGCCACCGTACTGGCGCAATCCATCGTTGCCGAAGGTATGAAATATGTTACCGCAGGTATGAATCCGACCGACCTGAAACGCGGTATCGATAAAGCCGTCGCCGCTTTGGTTGACGAACTGAAAAACATCGCCAAACCTTGCGACACTTCTAAAGAAATCGCCCAAGTCGGCTCTATTTCCGCCAACTCCGACGAACAAGTCGGCGCGATTATCGCCGAAGCGATGGAAAAAGTCGGCAAAGAAGGCGTGATTACCGTTGAAGACGGCAAGTCTTTGGAAAACGAGCTGGACGTAGTTGAAGGTATGCAGTTCGACCGCGGCTACCTGTCTCCTTACTTCATCAACGATGCGGAAAAACAAATCGCTGCTTTGGACAATCCGTTTGTATTGTTGTTCGACAAAAAAATCAGCAACATCCGCGACCTGCTGCCTGTTTTGGAACAAGTGGCAAAAGCCAGCCGTCCGCTGTTGATTATCGCTGAAGACGTAGAAGGCGAAGCCTTGGCGACTTTGGTCGTGAACAACATCCGAGGCATCCTGAAAACCGTTGCCGTCAAAGCCCCTGGCTTCGGCGACCGCCGCAAAGCGATGTTGCAAGACATCGCCATCCTGACCGGCGGCGTGGTGATTTCCGAAGAAGTCGGTCTGTCTTTGGAAAAAGCGACTTTGGACGACTTGGGTCAAGCCAAACGCATCGAAATCGGTAAAGAAAACACCACCATCATCGACGGCTTTGGCGACGCAGCCCAAATCGAAGCGCGTGTTGCCGAAATCCGCCAACAAATCGAAACCGCAACCAGCGATTACGACAAAGAAAAACTGCAAGAGCGCGTGGCTAAATTGGCAGGCGGCGTGGCAGTCATCAAAGTCGGTGCCGCGACCGAAGTCGAAATGAAAGAGAAAAAAGACCGCGTGGAAGACGCGCTGCACGCTACCCGCGCAGCCGTTGAAGAAGGCGTGGTTGCAGGCGGCGGCGTAGCCCTGTTGCGTGCCCGTGCTGCTTTGGAAAACCTGCACACCGGCAATGCCGACCAAGACGCAGGCGTACAAATCGTCTTGCGCGCCGTTGAGTCTCCGCTGCGCCAAATCGTTGCCAACGCAGGCGGCGAACCCAGCGTGGTTGTGAACAAAGTATTGGAAGGCAAAGGCAACTACGGTTACAACGCTGGCAGCGGCGAATACGGCGATATGATCGAAATGGGCGTACTCGACCCCGCCAAAGTAACCCGTTCTGCGCTGCAACACGCCGCATCTATCGCCGGCTTGATGCTGACCACTGATTGCATGATCGCTGAAATCCCCGAAGACAAACCGGCTGTGCCTGATATGGGCGGCATGGGTGGTATGGGCGGCATGATGTAA

SEQ ID NO: 2965 - DNA, 1635 bp, Neisseria meningitidis
atggcagcaaaagacgtacaattcggcaatgaagtccgccaaaaaatggtaaacggcgtgaacattttggcaaacgccgtgcgcgtaaccttgggtcccaaaggccgcaacgtggtggttgaccgcgctttcggcggcccgcacatcaccaaagacggcgtaaccgtcgccaaagaaatcgaactgaaagacaagtttgaaaatatgggcgcgcaaatggtgaaagaagtcgcgtccaaaaccaacgacgtggcgggcgacggtacgactaccgccaccgtattggcgcaatccatcgttgccgaaggtatgaaatacgttaccgccggtatgaacccgaccgacctgaaacgcggtatcgacaaagccgtcgccgctttggttgaagagctgaaaaacatcgccaaaccttgcgacacttctaaagaaatcgcccaagtcggctctatttccgccaactctgacgaacaagtcggcgcgattattgccgaagcgatggaaaaagtcggcaaagaaggcgtgattaccgttgaagacggcaaatctttggaaaacgagctggacgtggttgaaggtatgcaattcgaccgcggctacctgtctccttacttcatcaacgatgcggaaaaacaaatcgccggcttggacaatccgtttgtattgctgttcgacaaaaaaatcagcaatatccgcgacctgctgcctgttttggaacaagtggccaaagccagccgtccgctgttgattatcgctgaagacgtagaaggcgaagccttggcgactttggtcgtgaacaacatccgcggcattctgaaaaccgttgccgttaaagctccgggcttcggcgaccgccgcaaagcgatgctgcaagacatcgctatcctgaccggcggcacagtgatttccgaagaagtcggcctgtctttggaaaaagcgactttggacgacttgggtcaggccaaacgcatcgaaatcggtaaagaaaacaccaccatcatcgacggcttcggcgacgcagcccaaatcgaagcgcgtgttgccgaaatccgccaacaaatcgaaaccgcaaccagcgattacgacaaagaaaaactgcaagagcgcgttgccaaactggcaggcggcgtggcagtaatcaaagtcggtgccgcgaccgaagtggaaatgaaagagaaaaaagaccgcgtggaagacgcgctgcacgctacccgcgcagccgttgaagaaggcgtggttgcaggcggcggcgtagccctgttgcgcgcccgtgccgctctggaaaacctgcacaccggcaatgcagaccaagacgcaggcgtacaaatcgtcttgcgcgccgttgagtctccgctgcgccaaatcgttgccaacgcaggcggcgaacccagcgtggttgtgaacaaagtgttggaaggcaaaggcaactatggttacaacgctggcagcggcgaatacggcgacatgatcgaaatgggcgtactcgaccccgccaaagtaacccgttccgcgctgcaacacgccgcgtctatcgccggcctgatgctgaccacagactgcatgattgctgaaatccctgaagacaaaccggctatgcctgatatgggcggcatgggtggtatgggcggcatgatgtaa

SEQ ID NO: 2966 - protein, 544 aa, Neisseria meningitidis
MAAKDVQFGNEVRQKMVNGVNILANAVRVTLGPKGRNVVVDRAFGGPHITKDGVTVAKEIELKDKFENMGAQMVKEVASKTNDVAGDGTTTATVLAQSIVAEGMKYVTAGMNPTDLKRGIDKAVAALVEELKNIAKPCDTSKEIAQVGSISANSDEQVGAIIAEAMEKVGKEGVITVEDGKSLENELDVVEGMQFDRGYLSPYFINDAEKQIAGLDNPFVLLFDKKISNIRDLLPVLEQVAKASRPLLIIAEDVEGEALATLVVNNIRGILKTVAVKAPGFGDRRKAMLQDIAILTGGTVISEEVGLSLEKATLDDLGQAKRIEIGKENTTIIDGFGDAAQIEARVAEIRQQIETATSDYDKEKLQERVAKLAGGVAVIKVGAATEVEMKEKKDRVEDALHATRAAVEEGVVAGGGVALLRARAALENLHTGNADQDAGVQIVLRAVESPLRQIVANAGGEPSVVVNKVLEGKGNYGYNAGSGEYGDMIEMGVLDPAKVTRSALQHAASIAGLMLTTDCMIAEIPEDKPAMPDMGGMGGMGGMM

SEQ ID NO: 2967 - DNA, 1500 bp, Neisseria gonorrhoeae
gtgttcaaaaaataccaatacttcgctttggcggcactgtgtgccgccttgctggcaggctgcgaaaaggcaggcagctttttcggtgcggacaaaaaagaagcatccttcgtagaacgcatcgaacacaccaaagacgacggcagtgtcagtatgctgctgcccgactttgcccaactggttcaaagcgaaggcccggcagtcgtcaatattcaggcagcccccgccccgcgcacccaaaacggcagcggcaatgccgaaaccgattccgacccgcttgccgacagcgacccgttctacgaatttttcaaacgcctcgtcccgaacatgcccgaaatcccccaagaagaagcagatgacggcggattgaacttcggttcgggcttcatcatcagcaaaaacggctacatcctgaccaatacccacgtcgttgccggtatgggcagtatcaaagtcctgctcaacgacaagcgcgaatataccgccaaactcatcggttcggatgtccaatccgatgtcgcccttctgaaaatcgacgcaacggaagagctacccgtcgtcaaaatcggcaatcccaaaaatttgaaaccgggcgaatgggtcgctgccatcggcgcgcccttcggctttgacaacagcgtgaccgccggcatcgtgtccgccaaaggcagaagcctgcccaacgaaagctacacacccttcatccaaaccgacgttgccatcaatccgggcaattccggcggcccgctgttcaacttaaaaggacaggtcgtcggcatcaattcgcaaatatacagccgcagcggcggattcatgggcatctcctttgccatcccgattgacgttgccatgaatgtcgccgaacagctgaaaaacaccggcaaagtccaacgcggacaactgggcgtgattattcaggaagtatcctacggtttggcacagtcgttcggtctggataaagccagcggcgcattgattgccaaaatccttcccggcagccccgcagaacgtgccggcctgcaggcgggcgacatcgtcctcagcctcgacggcggagaaatacgttcttccggcgaccttcccgtcatggtcggcgccattacgccgggaaaagaagtcagcctcggcgtatggcgcaaaggcgaagaaatcacaatcaaagccaagctgggcaacgccgccgagcataccggcgcatcatccaaaacagatgaagccccctacaccgaacagcaatccggtacgttctcggtcgaatccgcaggcattacccttcagacacataccgacagcagcggcaaacacctcgtcgtcgtacgggtttccgacgcggcagaacgcgcaggcttaaggcgcggcgacgaaatcctcgcggtcgggcaagtccccgtcaatgacgaagccggtttccgcaaagctatggacaaggcaggcaaaaacgtccccctgctggtcatgcgccgtggcaacacgctgttcatcgcattaaacctgcaataa

SEQ ID NO: 2968 - protein, 499 aa, Neisseria gonorrhoeae
VFKKYQYFALAALCAALLAGCEKAGSFFGADKKEASFVERIEHTKDDGSVSMLLPDFAQLVQSEGPAVVNIQAAPAPRTQNGSGNAETDSDPLADSDPFYEFFKRLVPNMPEIPQEEADDGGLNFGSGFIISKNGYILTNTHVVAGMGSIKVLLNDKREYTAKLIGSDVQSDVALLKIDATEELPVVKIGNPKNLKPGEWVAAIGAPFGFDNSVTAGIVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKASGALIAKILPGSPAERAGLQAGDIVLSLDGGEIRSSGDLPVMVGAITPGKEVSLGVWRKGEEITIKAKLGNAAEHTGASSKTDEAPYTEQQSGTFSVESAGITLQTHTDSSGKHLVVVRVSDAAERAGLRRGDEILAVGQVPVNDEAGFRKAMDKAGKNVPLLVMRRGNTLFIALNLQ

SEQ ID NO: 2969 - DNA, 1500 bp, Neisseria meningitidis
gtgttcaaaaaataccaatacctcgctttggcagcactgtgtgcagcctcgctggcaggctgcgacaaggcaggcagcttcttcgtggcggacaaaaaagaagcatccttcgtagaacgcatcgaacacaccaaagacgacggcagcgtcagtatgctgctgcccgactttgcccaactggttcaaagtgaaggtccggcagtcgtcaatattcaggcagcccccgccccgcgcacccaaaacggcagcggcaatgccgaaaacgattccgacccgattgccgacaacgacccgttctacgaatttttcaaacgcctcgtcccgaatatgcccgaaatcccccaagaagaagcagatgacggcggattgaacttcggttcgggcttcatcatcagcaaagacggctacatcctgaccaatacccacgtcgttaccggcatgggcagtatcaaagtcctgctcaacgacaagcgcgaatataccgccaaactcatcggttcggatgtccaatccgatgtcgcccttctgaaaatcgacgcaacggaagagctgcccgtcgtcaaaatcggcaatcccaaagatttgaaaccgggcgaatgggtcgccgccatcggcgcgcccttcggcttcgacaacagcgtgaccgccggcatcgtgtccgccaaaggcagaagcctgcccaacgaaagctacacacccttcatccaaaccgacgttgccatcaatccgggcaactccggcggcccgctgttcaacttaaaaggacaggtcgtcggcatcaactcgcaaatatacagccgcagcggcggattcatgggcatttccttcgccatcccgattgacgttgccatgaatgtcgccgaacagctgaaaaacaccggcaaagtccaacgcggacaactgggcgtgattattcaagaagtatcctacggtttggcacaatcgttcggtttggacaaagccggcggcgcactgattgccaaaatcctgcccggcagccccgcagaacgtgccggcctgcaggcgggcgacatcgtcctcagcctcgacggcggagaaatacgttcttccggcgaccttcccgttatggtcggcgccattacgccgggaaaagaagtcagcctcggcgtatggcgcaaaggcgaagaaatcacaatcaaagtcaagctgggcaacgccgccgagcatatcggcgcatcatccaaaacagatgaagccccctacaccgaacagcaatccggtacgttctcggtcgaatccgcaggcattacccttcagacacataccgacagcagcggcggacacctcgtcgtcgtacgggtttccgacgcggcagaacgcgcaggcttgaggcgcggcgacgaaattcttgccgtcgggcaagtccccgtcaatgacgaagccggtttccgcaaagctatggacaaggcaggcaaaaacgtccccctgctgatcatgcgccgtggcaacacgctgtttatcgcattaaacctgcaataa

SEQ ID NO: 2970 - protein, 499 aa, Neisseria meningitidis
VFKKYQYLALAALCAASLAGCDKAGSFFVADKKEASFVERIEHTKDDGSVSMLLPDFAQLVQSEGPAVVNIQAAPAPRTQNGSGNAENDSDPIADNDPFYEFFKRLVPNMPEIPQEEADDGGLNFGSGFIISKDGYILTNTHVVTGMGSIKVLLNDKREYTAKLIGSDVQSDVALLKIDATEELPVVKIGNPKDLKPGEWVAAIGAPFGFDNSVTAGIVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKAGGALIAKILPGSPAERAGLQAGDIVLSLDGGEIRSSGDLPVMVGAITPGKEVSLGVWRKGEEITIKVKLGNAAEHIGASSKTDEAPYTEQQSGTFSVESAGITLQTHTDSSGGHLVVVRVSDAAERAGLRRGDEILAVGQVPVNDEAGFRKAMDKAGKNVPLLIMRRGNTLFIALNLQ

SEQ ID NO: 2971 - DNA, 1500 bp, Neisseria meningitidis
  misc_feature (363)..(363): n is a, c, g, or t
  misc_feature (652)..(652): n is a, c, g, or t
gtgttcaaaaaataccaatacctcgctttggcagcactgtgtgccgcctcgctggcaggctgcgacaaagccggcagctttttcggtgcggacaaaaaagaagcatcctttgtagaacgcatcaaacacaccaaagacgacggcagcgtcagtatgctgctgcccgactttgtccaactggttcaaagcgaaggcccggcagtcgtcaatattcaggcagcccccgccccgcgcacccaaaacggcagcagcaatgccgaaaccgattccgacccgcttgccgacagcgacccgttctacgaatttttcaaacgcctcgtcccgaacatgcccgaaatcccccaagaagaagcagatgacggnggattgaacttcggttcgggcttcatcatcagcaaagacggctatattctgaccaatacgcacgtcgttaccggcatgggcagtatcaaagtcctgctcaacgacaagcgcgaatataccgccaaactcatcggttcggatgtccaatccgatgtcgcccttctgaaaatcgacgcaacggaagagctgcccgtcgtcaaaatcggcaatcccaaagatttgaaaccgggcgaatgggtcgccgccatcggcgcgcccttcggcttcgacaacagcgtgaccgccggcntcgtgtccgccaaaggcagaagcctgcccaacgaaagctacacacccttcatccaaaccgacgttgccatcaatccgggcaactccggcggcccgctgttcaacttaaaaggacaggtcgtcggcatcaactcgcaaatatacagccgcagcggcggattcatgggcatttccttcgccatcccgattgacgttgccatgaatgtcgccgaacagctgaaaaacaccggcaaagtccaacgcggacaactgggcgtgattattcaagaagtatcctacggtttggcacaatcgttcggtttggacaaagccggcggcgcactgattgccaaaatcctgcccggcagccccgcagaacgtgccggcctgcgggcgggcgacatcgtcctcagcctcgacggcggagaaatacgttcttccggcgaccttcccgttatggtcggcgccattacgccgggaaaagaagtcagcctcggcgtatggcgcaaaggcgaagaaatcacaatcaaagtcaagctgggcaacgccgccgagcatatcggcgcatcatccaaaacagatgaagccccctacaccgaacagcaatccggtacgttctcggtcgaatccgcaggcattacccttcagacacataccgacagcagcggcggacacctcgtcgtcgtacgggtttccgacgcggcagaacgcgcaggcttgaggcgcggcgacgaaattcttgccgtcgggcaagtccccgtcaatgacgaagccggtttccgcaaagctatggacaaggcaggcaaaaacgtccccctgctgatcatgcgccgtggcaacacgctgtttatcgcattaaacctgcaataa

SEQ ID NO: 2972 - protein, 499 aa, Neisseria meningitidis
  misc_feature (218)..(218): Xaa can be any naturally occurring amino acid
VFKKYQYLALAALCAASLAGCDKAGSFFGADKKEASFVERIKHTKDDGSVSMLLPDFVQLVQSEGPAVVNIQAAPAPRTQNGSSNAETDSDPLADSDPFYEFFKRLVPNMPEIPQEEADDGGLNFGSGFIISKDGYILTNTHVVTGMGSIKVLLNDKREYTAKLIGSDVQSDVALLKIDATEELPVVKIGNPKDLKPGEWVAAIGAPFGFDNSVTAGXVSAKGRSLPNESYTPFIQTDVAINPGNSGGPLFNLKGQVVGINSQIYSRSGGFMGISFAIPIDVAMNVAEQLKNTGKVQRGQLGVIIQEVSYGLAQSFGLDKAGGALIAKILPGSPAERAGLRAGDIVLSLDGGEIRSSGDLPVMVGAITPGKEVSLGVWRKGEEITIKVKLGNAAEHIGASSKTDEAPYTEQQSGTFSVESAGITLQTHTDSSGGHLVVVRVSDAAERAGLRRGDEILAVGQVPVNDEAGFRKAMDKAGKNVPLLIMRRGNTLFIALNLQ

SEQ ID NO: 2973 - DNA, 1527 bp, Neisseria gonorrhoeae
atgaaaacacgcagcctcatttcccttttatgcctccttctctgttcatgttcttcatggttgcccccactggaagaacggacggaaagccgtcattttaatacttccaaacctgtcctcctggacaacatcctgcaaatccggcacacccctcataacaacgggctatccgacatctacctgctcgacgacccccacgaagcctttgccgcccgcgccgcccttatcgaatctgccgaacacagcctcgatttgcaatactacatttggcgcaacgacatttccggcaggctgctgttcaacctcatgtaccttgccgcagaacgcggcgtgcgcgtacgcctgctgttggacgacaacaacacgcgcggcttggacgatctcctgctcgccctcgacagccatcccaatatctaagtgcgcctgttcaaccccttcgtcctacgcaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgacctggacatcctcgccaccggcagcgtcgtcggcgaagtatcgcacgacttcgaccgctactgggcaagccattccgcccacaacgccacgcgcatcatccgcagcggcaacatcggcaagggtcttcaagcactcggatacaacgacgaaacatccagacacgcgctcctgcgctaccgcgaaaccgtcgaacagtcgcccctctaccaaaaaatacagacgggacgcatcgactggcagagcgtccaaacccgcctgatcagcgacagccctgcaaaaggactcgaccgcgaccgccgcaaaccgccgattgccgggaggctgcaagacgcgctcaaacagcccgaaaaaagcgtctatctggtttcaccctatttcgtccctacaaaatccggcacagacgcactggcaaaactggtgcaggacggcatagacgttaccgtcctgaccaactcgctacaggcgaccgacgttgccgccgtccattccggctacgtcaaataccgaaaaccgctgctcaaagccggcatcaaactctacgagctgcaacccaaccatgccgtccccgccacaaaagacaaaggcctgaccggcagctccgtaaccagcctgcatgccaaaaccttcattgtggacggcaaacgcatcttcatcggctcattcaacctcgacccccgttccgcacggctcaataccgaaatgggcgtcgtcatcgaaagccccaaaatcgcagaacagatggagcgcaccctcgccgataccacacccgaatacgcctaccgcgttaccctcgacaaacacaaccgcctgcaatggcacgatcccgccacccgaaaaacctacccgaacgaacccgaagccaaactttggaaacgcatcgccgcaaaaatcctatccctgctgcccatcgaaggtttattatag

SEQ ID NO: 2974 - protein, 507 aa, Neisseria gonorrhoeae
MKTRSLISLLCLLLCSCSSWLPPLEERTESRHFNTSKPVLLDNILQIRHTPHNNGLSDIYLLDDPHEAFAARAALIESAEHSLDLQYYIWRNDISGRLLFNLMYLAAERGVRVRLLLDDNNTRGLDDLLLALDSHPNIVRLFNPFVLRKWRALGYLTDFPRLNRRMHNKSFTADNRATILGGRNIGDEYFKVGEDTVFADLDILATGSVVGEVSHDFDRYWASHSAHNATRIIRSGNIGKGLQALGYNDETSRHALLRYRETVEQSPLYQKIQTGRIDWQSVQTRLISDSPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTTPEYAYRVTLDKHNRLQWHDPATRKTYPNEPEAKLWKRIAAKILSLLPIEGLL

SEQ ID NO: 2975 - DNA, 1527 bp, Neisseria meningitidis
atgaaaacacgcagcctaatttcccttttatgcctccttctctgttcatgttcttcatggttgcccccactggaagaacggacggaaagccgtcatttcaatacttccaaacccgtccgcctggacaacatcctgcaaatccggcacacccctcataccaacgggctatccgatatctatctgttgaacgacccccacgaagcctttgccgcccgcgccgcccttatcgaatctgccgaacacagcctcgatttgcaatactacatctggcgcaacgacatttccggcaggctgctgttcaacctcgtgtaccttgccgcagaacgcggtgtgcgcgtacgcctgctgttggacgacaacaacacgcgcggattggacgacctcctgcttgccctcgacagccatcccaatatcgaagtgcgcctgttcaaccccttcgtcttacgaaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgatttggacatcctcgccaccggcagcgtcgtcggcgaagtatcgcacgacttcgaccgctactgggcaagccattccgcccacaacgccacgcgcatcatccgcagcggcgacatcggcaagggtcttcaagcactcggatacaacgacgaaacgtccagacacgcgctcctgcgctaccgcgaaaccgtcgaacagtcgcccctctaccaaaaaatacagacaggatgcatcgactggcagagcgtccgaacccgcctcatcagcgacgaccctgcaaaaggactcgaccgcgaccgccgcaaaccgccgattgccgggcggctgcaagacgcgctcaaacagcccgaaaaaagcgtctatctggtttcaccctatttcgttcccacaaaatccggcacagacgcactggcaaaactggtgcaggacggcatagacgttaccgttctgaccaactcgctgcaggcgaccgacgttgccgccgtccattccggctatgtcaaataccgaaaaccgctgctcaaagccggcatcaaactctacgagctgcaacccaaccatgccgtccccgccacaaaagacaaaggcctgaccggcagctccgtaaccagcctgcacgccaaaaccttcattgtggacggcaaacgcatcttcatcggttcgttcaacctcgacccccgttccgcgcgtctcaacaccgaaatgggcgttgttatcgaaagccccaaaatcgcagaacagatggagcgcacccttgccgataccacacccgcctacgcctaccgcgttaccctcgacaggcacaaccgcctgcaatggcacgatcccgccacccgaaaaacctacccgaacgaacccgaagccaaactttggaaacgcatcgccgcaaaaatcctatccctgctgcccatagaaggtttattatag

SEQ ID NO: 2976 - protein, 508 aa, Neisseria meningitidis
MKTRSLISLLCLLLCSCSSWLPPLEERTESRHFNTSKPVRLDNILQIRHTPHTNGLSDIYLLNDPHEAFAARAALIESAEHSLDLQYYIWRNDISGRLLFNLVYLAAERGVRVRLLLDDNNTRGLDDLLLALDSHPNIEVRLFNPFVLRKWRALGYLTDFPRLNRRMHNKSFTADNRATILGGRNIGDEYFKVGEDTVFADLDILATGSVVGEVSHDFDRYWASHSAHNATRIIRSGDIGKGLQALGYNDETSRHALLRYRETVEQSPLYQKIQTGCIDWQSVRTRLISDDPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTTPAYAYRVTLDRHNRLQWHDPATRKTYPNEPEAKLWKRIAAKILSLLPIEGLL

SEQ ID NO: 2977 - DNA, 1527 bp, Neisseria meningitidis
atgaaaacacgcagcctaatttcccttttatgcctccttctctgttcatgttcttcatggttgcccccactggaagaacggacggaaagccgtcatttcaatacttccaaacccgtccgcctggacaacatcctgcaaatccggcacacccctcataccaacgggctatccgatatctatctgttgaacgacccccacgaagcctttgccgcccgcgccgcccttatcgaatctgccgaacacagcctcgatttgcaatactacatctggcgcaacgacatttccggccgactgctgttcaacctcgtgtaccttgccgcagaacgcggtgtgcgcgtacgcctgctgttggacgacaacaacacgcgcggattggacgacctcctgctcgccctcgacagccatcccaatatcgaagtgcgcctgttcaaccccttcgtcttacgaaaatggcgcgcactcggctacctgaccgacttcccccgcctcaaccgccgcatgcacaacaaatcctttaccgccgacaaccgcgccaccatactcggcggacgcaatatcggcgacgaatacttcaaagtcggtgaggacaccgttttcgccgacctggacatcctcgccaccggcagcgtcgtcggcgaagtatcgcacgacttcgaccgctactgggcaagccattccgcccacaacgccacgcgcatcatccgcagcggcaacatcggcaagggtcttcaagcactcggatacaacgacgaaacgtccagacacgcgctcctgcgctaccgcgaaaccgtcgaacagtcgcccctctaccaaaaaatacagacaggacgcatcgactggcagagcgtccaaacccgcctcatcagcgacgaccctgcaaaaggactcgaccgcgaccgccgcaaaccgccgattgccgggcggctgcaagacgcgctcaaacagcccgaaaaaagcgtctatctggtttcaccctatttcgtccccacaaaatccggcacagacgcactggcaaaactggtgcaggacggcatagacgttaccgtcctgaccaactcgctacaggcgaccgacgttgccgccgtccattccggctatgtcaaataccgaaaaccgctgctcaaagccggcatcaaactctacgagctgcaacccaaccatgccgtccctgccacaaaagacaaaggcctgaccggcagctccgtaaccagcctgcatgccaaaaccttcattgtggacggcaaacgcatcttcatcggctcattcaacctcgacccccgttccgcacggctcaatactgaaatgggcgttgttatcgaaagccccaaaatcgcagaacagatggagcgcacccttgccgatacctcacccgaatacgcctaccgcgttaccctcgacaggcacaaccgcctgcaatggcacgatcccgccacccgaaaaacctacccgaacgaacccgaagccaaactttggaaacgcatcgccgcaaaaatcctatccctgctgcccatagaaagtttattatag

SEQ ID NO: 2978 - protein, 508 aa, Neisseria meningitidis
MKTRSLISLLCLLLCSCSSWLPPLEERTESRHFNTSKPVRLDNILQIRHTPHTNGLSDIYLLNDPHEAFAARAALIESAEHSLDLQYYIWRNDISGRLLFNLVYLAAERGVRVRLLLDDNNTRGLDDLLLALDSHPNIEVRLFNPFVLRKWRALGYLTDFPRLNRRMHNKSFTADNRATILGGRNIGDEYFKVGEDTVFADLDILATGSVVGEVSHDFDRYWASHSAHNATRIIRSGNIGKGLQALGYNDETSRHALLRYRETVEQSPLYQKIQTGRIDWQSVQTRLISDDPAKGLDRDRRKPPIAGRLQDALKQPEKSVYLVSPYFVPTKSGTDALAKLVQDGIDVTVLTNSLQATDVAAVHSGYVKYRKPLLKAGIKLYELQPNHAVPATKDKGLTGSSVTSLHAKTFIVDGKRIFIGSFNLDPRSARLNTEMGVVIESPKIAEQMERTLADTSPEYAYRVTLDRHNRLQWHDPATRKTYPNEPEAKLWKRIAAKILSLLPIESLL

SEQ ID NO: 2979 - DNA, 2379 bp, Neisseria gonorrhoeae
atgaataaaaatattaaatctttaaatttacgggaaaaagacccgtttttaagtcgtgaaaaacagcgttatgaacatcctttgcccagtcgggaatggataatcgaattgttggagcgcaaaggtgtgccttcaaaaatcgaatcgcttgcacgcgagctgtcgattacggaagacgagtatgtcttttttgaacgccgtctgaaggcgatggcgcgggacggtcaggttttaatcaaccgccgaggcgcagtttgcgcggcggacaagctggatttggtcaaatgccgcgtcgaggcgcataaggacggtttcggcttcgccgtgccgctcatgccgatggacgaaggggatttcgttttatacgaacgccagatgcgtggtgtcatgcacggcgacaccgttaccgtccgtcctgcgggtatggaccgcaggggccgccgcgaagggacgtttctggatattgtcgaacgcgcgcaaagcaaagttgtcggccgtttctatatggataggggcgtggcgattttggagccggaagacaagcgtctgaaccaaagcatcgtgttggaaccggacggcgtggcgcgtttcaaacccgaatccggtcaggttatcgtcggcaaaattgaggtttatcccgagcaaaaccggcctgcagtggcaaaaatcattgaagttttgggcgattatgccgacagcgggatggaaatcgaaattgccgtgcgcaagcatcatttgccgcaccgattcagtgaagcgtgtgccaaatccgcgaaaaaaattcccgaccatgtacgcaaaagcgatttgaaaggccgcgtcgatttgtgcgaccttcctttggtaacgatagacggcgaaacggcgcgcgatttcgacgacgcggtgtttgccgaaaaagtcggacgcaattaccgcctggtcgtggcgattgcggatgtcagccattatgtccgccctgacgatgcgattgatgcagatgctcaagaacgcagtaccagcgtgtatttcccgcgccgtatgattccgatgctgccggaaaacctgtccaacggcatctgctcgctcaatcccgatgtcgagcgtttgtgtatggtgtgcgatatggtcgttacctatgcgggcaatatcaaagaataccgcttctatcccgccgtgatgcgctctcatgcccgcctgacctacaaccaagtttggaaatggctttcagacggcatcgggaatccgcacaaagcccaaatcgacacgctttacaagctgtttaaaattttgcagaaaaaacgtctggcgcgcggggcggtggagtttgaaagcgtcgaaacccagatgattttcgacgacaacggcaaaatcgaaaaaattgtccccgtcgtccgcaacgatgcccacaagctgattgaagaatgtatgctggcggcgaatgtttgcgcggcggattttctgttgaaaaacaaacatacggctttgttccgcaaccatttgggccccacgcccgaaaaactcgccaccctgcgcgagcagctcggtctgttggggcttcaacttggcggcggcgacaacccgtcgccgaaagactatgccgcgcttgccgaacaattcaaaggcaggccggatgccgaattgctgcaagtcatgatgttgcgctccatgcagcaggcggtttacgaaccgcattgcgaagggcatttcggtttggcttatgaagcatacgcccactttacctcgcccatccgccgctatcccgacctgaccgtccaccgtgccatcaaagccgtattgaaccggaaaacctacacgccaaacaaaagctggcaggctttgggcgtgcatacttcgttttgcgaacgccgtgccgacgatgctggccgcgatgtggaaaactggctgaaaacttattatatgcgcgataaggtcggtgaaatatttgaaggcaaaatctcccggggtgtggcaaattttggaatatttgtcactttggacgatatccatatcgacggtctggtacatatcagcgatttgggcgaagattatttcaacttccgccccgaaatcatggcaatcgaaggcgaacgcagcggcatccgtttcaatatgggggacagggttgccgtccgggtcgcgcgtgccgatttggatgatggaaaaatcgactttgtcctaattgccggagaaagcggcaggcggcggaaggtcaaattatccgcatctgccaaaccggcaggggcggcggggaaagggaaatcgaaaaccaccgccgagaaaaaaacagcccgatgcggcaaagtaaggggaaggggcgtgcctgccgttgccgaatcggggaaaaaggcaaagaaaccggttccgattaaggtcaaaaaacggaaaggcaaatcataa

SEQ ID NO: 2980 - protein, 792 aa, Neisseria gonorrhoeae
MNKNIKSLNLREKDPFLSREKQRYEHPLPSREWIIELLERKGVPSKIESLARELSITEDEYVFFERRLKAMARDGQVLINRRGAVCAADKLDLVKCRVEAHKDGFGFAVPLMPMDEGDFVLYERQMRGVMHGDTVTVRPAGMDRRGRREGTFLDIVERAQSKVVGRFYMDRGVAILEPEDKRLNQSIVLEPDGVARFKPESGQVIVGKIEVYPEQNRPAVAKIIEVLGDYADSGMEIEIAVRKHHLPHRFSEACAKSAKKIPDHVRKSDLKGRVDLCDLPLVTIDGETARDFDDAVFAEKVGRNYRLVVAIADVSHYVRPDDAIDADAQERSTSVYFPRRMIPMLPENLSNGICSLNPDVERLCMVCDMVVTYAGNIKEYRFYPAVMRSHARLTYNQVWKWLSDGIGNPHKAQIDTLYKLFKILQKKRLARGAVEFESVETQMIFDDNGKIEKIVPVVRNDAHKLIEECMLAANVCAADFLLKNKHTALFRNHLGPTPEKLATLREQLGLLGLQLGGGDNPSPKDYAALAEQFKGRPDAELLQVMMLRSMQQAVYEPHCEGHFGLAYEAYAHFTSPIRRYPDLTVHRAIKAVLNRKTYTPNKSWQALGVHTSFCERRADDAGRDVENWLKTYYMRDKVGEIFEGKISRGVANFGIFVTLDDIHIDGLVHISDLGEDYFNFRPEIMAIEGERSGIRFNMGDRVAVRVARADLDDGKIDFVLIAGESGRRRKVKLSASAKPAGAAGKGKSKTTAEKKTARCGKVRGRGVPAVAESGKKAKKPVPIKVKKRKGKS

SEQ ID NO: 2981 - DNA, 1926 bp, Neisseria meningitidis
acagttctggatattgtcgaacgcgcgcaaagcaaagtggtcggccgtttctatatggataggggcgtggcgattttggagccggaagacaagcgtctgaaccaaagcatcgtattggaaccggacggcgtggcgcgtttcaaacctgaatccggtcaggtcatcgtcggcgaaattgaggtttatcctgagcaaaaccggccggcagtggcaaaaatcatcgaagttttgggcgattatgccgacagcggcatggagattgaaattgccgtgcgcaagcatcatttgccgcaccaattcagtgaagcgtgtgccaaagctgcgaaaaaaattcccgtccatgtacgcaaaagcgatttgaaaggccgcgtcgatttgcgcgacctgcctttggtaacgatagacggcgaaacggcgcgcgatttcgacgacgcggtgtttgccgaaaaagtcggacgcaattaccgtctggtcgtggcgattgcggatgtcagccattatgtccgccctgacgatgtgattgatgcagatgctcaagaacgcagtaccagcgtatatttcccgcgccgtgtgattccgatgctgccggaaaacctgtctaacggcatttgctcgctcaatcccgatgtcgagcgtttgtgtatggtgtgcgatatggtcgttacctatgcgggcaatatcaaagaataccgcttctaccccgccgtaatgcgctctcatgcccgcctgacctacaaccaagtttggaaatggatttcagacggcatcgaccatccgtacaaagcccaaatcgacaccctttacaaactcttcaaaatccttcagaaaaagcgtttcgaacgcggcgcggtggagtttgaaagcgtcgaaacccagatgattttcgatgacaacggcaaaatcgaaaaaatcgtccccgttgtccgcaacgatgcccacaagctgattgaagaatgtatgctggcggcgaatgtttgcgcagcggatttcctgttgaaaaacaagcatacggctttgttccgcaaccatttgggccccacgcccgaaaaactcgccaccctgcgcgagcagctcggtctgttggggcttcaacttggcggcggcgacaacccgtcgccgaaagactatgccgcgcttgtcgaacaattcaaaggcagacctgatgccgaattgctgcaagtcatgatgttgcgctccatgcagcaggcggtttacgaaccgcattgcgacggacactttggtcttgcctacgaagcatacgcccacttcacctcgcccatccgccgctatcccgacctgaccgtacaccgcgccatcaaagccgtgttgaatcagcaaacctacacgccaaaaaaaagctggcaggctttgggcgtgcatacctcgttctgtgagcgccgtgccgacgacgccagccgcgacgtggaaaactggctgaaaacctattatatgcgcgataaggtcggcgaagtattcgaaggtaaaatctccggcatgaccagttttggtatctttgtaacactggacggcatccacattgacggcttggtgcatatcagcgatttgggcgaagactatttcaacttccgccccgaaatcatggcaatcgaaggcgaacgcagcggcatccgtttcaacatgggggacagggttgccgtccgggtcgcccgtgccgatttggatgacggaaaaatcgattttgtcctgattgccggggggagcggcagggggcggaaagttaaatcatccgcgtctgccaaaccggcagggacggcggggaaagggaagccgaaaaccgccgccgagaaaaaaacagcccgaggcggcaaagtaaggggaaggggcgcgtctgccgccgcagaatcgaggaaaaaggcaaagaaaccggttccgattaaggtaaaaaaacggaaaggcaaatcataa

SEQ ID NO: 2982 - protein, 641 aa, Neisseria meningitidis
TVLDIVERAQSKVVGRFYMDRGVAILEPEDKRLNQSIVLEPDGVARFKPESGQVIVGEIEVYPEQNRPAVAKIIEVLGDYADSGMEIEIAVRKHHLPHQFSEACAKAAKKIPVHVRKSDLKGRVDLRDLPLVTIDGETARDFDDAVFAEKVGRNYRLVVAIADVSHYVRPDDVIDADAQERSTSVYFPRRVIPMLPENLSNGICSLNPDVERLCMVCDMVVTYAGNIKEYRFYPAVMRSHARLTYNQVWKWISDGIDHPYKAQIDTLYKLFKILQKKRFERGAVEFESVETQMIFDDNGKIEKIVPVVRNDAHKLIEECMLAANVCAADFLLKNKHTALFRNHLGPTPEKLATLREQLGLLGLQLGGGDNPSPKDYAALVEQFKGRPDAELLQVMMLRSMQQAVYEPHCDGHFGLAYEAYAHFTSPIRRYPDLTVHRAIKAVLNQQTYTPKKSWQALGVHTSFCERRADDASRDVENWLKTYYMRDKVGEVFEGKISGMTSFGIFVTLDGIHIDGLVHISDLGEDYFNFRPEIMAIEGERSGIRFNMGDRVAVRVARADLDDGKIDFVLIAGGSGRGRKVKSSASAKPAGTAGKGKPKTAAEKKTARGGKVRGRGASAAAESRKKAKKPVPIKVKKRKGKS

SEQ ID NO: 2983 - DNA, 2376 bp, Neisseria meningitidis
  misc_feature (504)..(504): n is a, c, g, or t
atgaataaaaatattaaatctttaaatttacgggaaaaagacccgtttttaagtcgtgaaaaacagcgttatgaacatcctttgcccagtcgggaatggataatcgagctgcttgaacgtaaaggcgtaccatccaagattgaagctttggtacgcgaattgtcgattaaggaagaagagtacgaatttttcgaacgtcgtctgaaggcgatggcgcgggacggtcaggttttaatcaaccgtcggggcgcggtttgcgcggcggacaaattggatttggtcaaatgccgtgtcaaggcgcacaaagaccgcttcggtttcgccgtgccgctcacgcccgccaaagacggtgattttgtcttgtacgaacgccagatgcgcggcattatgcacggcgatattgtcactgttcgtcctgccggcatggacggtaggggccgccgcgaagggacggttctggatattgtcgaacgcgcgcaaagcaaagtggtcggccgtttctanatggataggggcgtggcgattttggagccggaagacaagcgtctgaaccaaagcatcgtattggaaccggacggcgtggcgcgtttcaaacctgaatccggtcaggtcatcgtcggcgaaattgaggtttatcctgagcaaaaccggccggcagtggcaaaaatcatcgaagttttgggcgattatgccgacagcggcatggagattgaaattgccgtgcgcaagcatcatttgccgcaccaattcagtgaagcgtgtgccaaagccgcgaaaaaaattcccgaccatgtacgcaaaagcgatttgaaaggccgcgtcgatttgcgcgacctgcctttggtaacgatagacggcgaaacggctcgagattttgacgatgcggtgtttgccgagaaaatcggacgcaattaccgtctggtcgtggcgattgccgatgtcagccattatgtccgccccgatgacgctatcgacacggacgctcaggaacgcagcaccagtgtttacttcccgcgccgcgtgattcccatgttgccggaaaacctgtccaacggcatctgctcgctcaatcctcatgtcgagcgtttgtgtgtggtgtgcgatatggttatcacttacgcgggcaatatcaaagaataccgcttctaccccgccgtgatgcgctctcatgcccgcctgacctacaaccaagtttggaaatggctttcaggcggcatcgagcatccgttcaaaacccaaatcgacacgctttacaaactcttcaaaatccttcagaaaaagcgtttcgaacgcggggcggtggagtttgacagcatcgaaacccaaatgcttttcgacgacaacggtaaaattgaaaaaatcgtccccgttgtccgcaacgatgcccacaagctgattgaagaatgtatgttggcggcaaacgtttgcgcagcggattttctgttgaaaaacaagcataccgcattgttccgcaaccatttggggcccacgcccgaaaaactcgccgccttgcgcgagcagctcggtctgttggggcttcaacttggcggcggcgacaacccgtcgccgaaagactatgccgcgcttgccggacagttcaaaggcaggccggatgccgaattgctgcaagtcatgatgttgcgctccatgcaacaggcggtttacgaaccgcattgcgacggacactttggtcttgcctacgaagcatacgcccacttcacctcgcccatccgccgctatcccgacctgaccgtacaccgcgccatcaaagccgtgttgaatcagcaaacctacacgccaaaaaaaagctggcaggctttgggcgtgcatacctcgttctgtgagcgccgtgccgacgacgccagccgcgacgtggaaaactggctgaaaacctattatatgcgcgataaggtcggcgaagtattcgaaggtaaaatctccggcatgaccagttttggtatctttgtaacactggacggcatccacattgacggcttggtgcatatcagcgatttgggcgaagactatttcaacttccgccccgaaatcatggcaatcgaaggcgaacgcagcggcatccgtttcaacatgggggacagggttgccgtccgggtcgcccgtgccgatttggatgacggaaaaatcgattttgtcctgattgccggggggagcggcagggggcggaaagttaaatcatccgcgtctgccaaaccggcagggacggcggggaaagggaagccgaaaaccgccgccgagaaaaaaacagcccgaggcggcaaagtaaggggaaggggcgcgtctgccgccgcagaatcgaggaaaaaggcaaagaaaccggttccgattaaggtaaaaaaacggaaaggcaaatcataa

SEQ ID NO: 2984 - protein, 791 aa, Neisseria meningitidis
  misc_feature (168)..(168): Xaa can be any naturally occurring amino acid
MNKNIKSLNLREKDPFLSREKQRYEHPLPSREWIIELLERKGVPSKIEALVRELSIKEEEYEFFERRLKAMARDGQVLINRRGAVCAADKLDLVKCRVKAHKDRFGFAVPLTPAKDGDFVLYERQMRGIMHGDIVTVRPAGMDGRGRREGTVLDIVERAQSKVVGRFXMDRGVAILEPEDKRLNQSIVLEPDGVARFKPESGQVIVGEIEVYPEQNRPAVAKIIEVLGDYADSGMEIEIAVRKHHLPHQFSEACAKAAKKIPDHVRKSDLKGRVDLRDLPLVTIDGETARDFDDAVFAEKIGRNYRLVVAIADVSHYVRPDDAIDTDAQERSTSVYFPRRVIPMLPENLSNGICSLNPHVERLCVVCDMVITYAGNIKEYRFYPAVMRSHARLTYNQVWKWLSGGIEHPFKTQIDTLYKLFKILQKKRFERGAVEFDSIETQMLFDDNGKIEKIVPVVRNDAHKLIEECMLAANVCAADFLLKNKHTALFRNHLGPTPEKLAALREQLGLLGLQLGGGDNPSPKDYAALAGQFKGRPDAELLQVMMLRSMQQAVYEPHCDGHFGLAYEAYAHFTSPIRRYPDLTVHRAIKAVLNQQTYTPKKSWQALGVHTSFCERRADDASRDVENWLKTYYMRDKVGEVFEGKISGMTSFGIFVTLDGIHIDGLVHISDLGEDYFNFRPEIMAIEGERSGIRFNMGDRVAVRVARADLDDGKIDFVLIAGGSGRGRKVKSSASAKPAGTAGKGKPKTAAEKKTARGGKVRGRGASAAAESRKKAKKPVPIKVKKRKGKS

SEQ ID NO: 2985 - DNA, 1383 bp, Neisseria gonorrhoeae
atgacccctttcacactgaaaaaaaccgtcctgctgctcggcactgcctttgccgccgcatctgtccacgcatccggctaccacttcggcacacagtcggtcaacgcgcaaagcacggcaaatgccgccgacgcgtcgaccatcttctacaatcccgccggcctgaccaaactcgacagcagccagatttccgtcaacgccaacatcgtgctgcccagcattcattatgaagcagattccgccaccgactttaccgggcttcccgtccaaggttctaaaaacggcaaaatcaccaaaaccacggtcgcaccccacatttacggcgcatacaaagtcaacgacaatctgaccgtgggcttgggcgtgtacgtccccttcggctctgccaccgaatacgaaaaagattccgtgttgcgccacaacatcaacaaactcggtctgaccagcatcgccgtcgaacctgtcgccgcgtggaaactcaacgaacgccattccttcggcgcaggcatcatcgcccaacataattccgccgaactgcgcaaatatgccgactgaggaatcccaaaaaaagcgcaaatgctgcaagcaacaccttctaatcctactgccgctgctcaaatcaaggccgacggacacgccgatgtcaaaggcagcgattggggcgtcggctaccaactggcgtggatgtgggacatcaacgaccgcgcgcgcgtgggcgtgaactaccgttccaaagtttcacacacgctcaaaggcgatgccgaatgggcggcagacggcgcggcggcgaaacaacagtggaatgacaatatgctcacaccgctcggttacacggcgaatgaaaaagccagtgtcaaaatcgtaacgcctgagtctttgtccgtacacggcatgtacaaagtgtccgacaaagccgacctgttcggcgacgtaacttggacgcgccacagccgcttcaataaggcggaactgttttttgaaaaagaaaaaaatattgctaatggcaaaaaatccgaccgcaccaccatcacccccaactggcgcaacacctacaaagtcggcttgggcggttcttatcaaatcagcgaaccgctgcaactgcgcgtcggcatcgcttttgacaaaccgcctgtccgcaacgccgactaccgcatgaacagcctgcccgacggcaaccgcatctggttctccgccggcatgaaataccatatcggcaaaaaccacgtcgtcgatgccgcctacacccacatccacatcaacgacaccagctaccgcacggcgaaggcaagcggcaacgatgtggacagcaaaggtgcgtcttgcgcacgtttcaaaaaccacgccgacatcatcggcctgcaatacacctacaaattcaaataa

SEQ ID NO: 2986 - protein, 459 aa, Neisseria gonorrhoeae
MTPFTLKKTVLLLGTAFAAASVHASGYHFGTQSVNAQSTANAADASTIFYNPAGLTKLDSSQISVNANIVLPSIHYEADSATDFTGLPVQGSKNGKITKTTVAPHIYGAYKVNDNLTVGLGVYVPFGSATEYEKDSVLRHNINKLGLTSIAVEPVAAWKLNERHSFGAGIIAQHNSAELRKYADGIPKKAQMLQATPSNPTAAAQIKADGHADVKGSDWGVGYQLAWMWDINDRARVGVNYRSKVSHTLKGDAEWAADGAAAKQQWNDNMLTPLGYTANEKASVKIVTPESLSVHGMYKVSDKADLFGDVTWTRHSRFNKAELFFEKEKNIANGKKSDRTTITPNWRNTYKVGLGGSYQISEPLQLRVGIAFDKPPVRNADYRMNSLPDGNRIWFSAGMKYHIGKNHVVDAAYTHIHINDTSYRTAKASGNDVDSKGASCARFKNHADIIGLQYTYKFK

SEQ ID NO: 2987 - DNA, 1401 bp, Neisseria meningitidis
atgaccccttccgcactgaaaaaaaccgtcctgctgctcggcactgcctttgccgccgcatccgtccacgcatccggctaccacttcggcacacagtcggtcaacgcgcaaagcacggcaaatgccgccgccgcagaagccgccgacgcatcgaccatcttctacaaccctgccggcctgaccaaactcgacagcagccagatttccgtcaacgccaacatcgtgctgcccagcattcattatgaggcggattccgccaccgactttaccgggcttcccgtccaaggttcgaaaagcggcaaaatcaccaaaaccacggtcgcgccccacatctacggcgcatacaaagtcaacgacaatctgaccgtgggcttgggcgtgtacgtccccttcggctctgccaccgaatacgaaaaagattccgtgttgcgccacaacatcaacaaactcggtctgaccagcatcgccgtcgaacctgtcgccgcgtggaaactcaacgaccgccattccttcggcgcaggcatcatcgcccaacatacttccgccgaactgcgcaaatatgccgactgggggattaagagtaaagcagagatattgacggcaaaaccgcccaaacctaacggtgtagccgaagctgcaaaaattcaggccgacggacacgccgatgtcaaaggcagcgattggggcttcggctaccaactggcgtggatgtgggacatcaacgaccgtgcgcgcgtgggcgtgaactaccgttccaaagtctcgcacacgctcaaaggcgatgccgaatgggcggcagacggcgcggcggcgaaagcaatgtggagtacgatgcttgcagcaaacggctacacggcgaatgaaaaagcccgcgttaaaatcgttacgcctgagtctttgtccgtacacggtatgtacaaagtgtccgataaagccgacctgttcggcgacgtaacttggacgcgccacagccgcttcgataaggcggaactggtttttgaaaaagaaaaaaccgtcgtcaaaggcaaatccgaccgcaccaccatcacccccaactggcgcaacacctacaaagtcggcttcggcggttcttatcaaatcagcgaaccgctgcaactgcgcgccggcatcgcttttgacaaatcgcccgtccgcaacgccgactaccgcatgaacagcctacccgacggcaaccgcatctggttctccgccggtatgaaataccatatcggtaaaaaccacgtcgtcgatgccgcctacacccacatccacatcaacgacaccagctaccgcacggcgaaggcaagcggcaacgatgtggacagcaaaggcgcgtcttccgcacgtttcaaaaaccacgccgacatcatcggtctgcaatacacctacaaattcaaataa

SEQ ID NO: 2988 - protein, 466 aa, Neisseria meningitidis
MTPSALKKTVLLLGTAFAAASVHASGYHFGTQSVNAQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNDRHSFGAGIIAQHTSAELRKYADWGIKSKAEILTAKPPKPNGVAEAAKIQADGHADVKGSDWGFGYQLAWMWDINDRARVGVNYRSKVSHTLKGDAEWAADGAAAKAMWSTMLAANGYTANEKARVKIVTPESLSVHGMYKVSDKADLFGDVTWTRHSRFDKAELVFEKEKTVVKGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADIIGLQYTYKFK

SEQ ID NO: 2989 - DNA, 1395 bp, Neisseria meningitidis
atgaccccttccgcactgaaaaaaaccgtcctactgctcggcactgcctttgccgccgcatccgcacaagcctccggctaccacttcggcacacagtcggtcaacgcgcaaagcacggcaaatgccgccgccgcagaagccgccgacgcatcgaccatcttctacaaccctgccggcctgaccaaactcgacagcagccagatttccgtcaacgccaacatcgtgctgcccagcattcattatgaggcggattccgccaccgactttaccgggcttcccgtccaaggttcgaaaagcggcaaaatcaccaaaaccacggtcgcgccccacatctacggcgcatacaaagtcaacgacaatctgaccgtaggcttgggcgtgtacgtccccttcggttctgccaccgaatacgaaaaagattccgtgttgcgccacaacatcaacaaactcggtctgaccagcatcgccgtcgaacctgtcgccgcgtggaaactcaacgaacgccattccttcggcgcaggcatcatcgcccaacatacttccgccgagctgcgcaaatatgccgactgggggattatggaaaaagcgaaagcactaaaagaaacaccccccaatccaactaaagccgcccaaatcaaagccgacggacacgccgatgtcaaaggcagcgattggggcttcggctaccaactggcgtggatgtgggacatcaacgaccgtgcgcgcgtgggcgtgaactaccgttccaaagtctcacacacgctcaaaggcgatgccgaatgggcggcagacgacgcaatggcgaaacagttatgggatgcaaacaaactcgcactgctcggctacacgccaagcgaaaaagcccgcgttaaaatcgttacgcccgagtctttgtccgtacacggtatgtacaaagtgtccgacaaagccgacctgttcggcgacgtaacttggacgcgccacagccgcttcgataaggcggaactggtttttgaaaaagaaaaaaccatcgtcaacggcaaatccgaccgcaccaccatcacccccaactggcgcaacacctacaaagtcggcttcggcggttcttatcaaatcagcgaaccgctgcaactgcgcgccggcatcgcttttgacaaatcgcccgtccgcaacgccgactaccgcatgaacagcctgcccgacggcaaccgcatctggttctccgccggcatgaaataccatatcggcaaaaaccacgtcgtcgatgccgcctacacccacatccacatcaacgacaccagctaccgcacggcgaaggcaagcggcaacgatgtggacagcaaaggcgcgtcttccgcacgtttcaaaaaccacgccgacatcatcggcctgcaatacacctacaaattcaaataa

SEQ ID NO: 2990 - protein, 464 aa, Neisseria meningitidis
MTPSALKKTVLLLGTAFAAASAQASGYHFGTQSVNAQSTANAAAAEAADASTIFYNPAGLTKLDSSQISVNANIVLPSIHYEADSATDFTGLPVQGSKSGKITKTTVAPHIYGAYKVNDNLTVGLGVYVPFGSATEYEKDSVLRHNINKLGLTSIAVEPVAAWKLNERHSFGAGIIAQHTSAELRKYADWGIMEKAKALKETPPNPTKAAQIKADGHADVKGSDWGFGYQLAWMWDINDRARVGVNYRSKVSHTLKGDAEWAADDAMAKQLWDANKLALLGYTPSEKARVKIVTPESLSVHGMYKVSDKADLFGDVTWTRHSRFDKAELVFEKEKTIVNGKSDRTTITPNWRNTYKVGFGGSYQISEPLQLRAGIAFDKSPVRNADYRMNSLPDGNRIWFSAGMKYHIGKNHVVDAAYTHIHINDTSYRTAKASGNDVDSKGASSARFKNHADIIGLQYTYKFK

SEQ ID NO: 2991 - DNA, 1860 bp, Neisseria meningitidis
atgttcagagctcagcttggttcaaatactcgttctaccaaaatcggcgacgatgccgatttttcattttcagacaagccgaaacccggcacttcccattatttttccagcggtaaaaccgatcaaaattcatccgaatatgggtatgacgaaatcaatatccaaggtaaaaattacaatagcggcatcctcgccgtcgataatatgcccgttgtcaaaaaatatattacagagaagtatggggctgatttaaagcaggcggttaaaagtcaattacaggatttatacaaaacaagaccggaagcttgggcagaaaataaaaaacggactgaggaggcgtatatagcacagtttggaacaaaatttagtacgctcaaacagacgatgcccgatttaattaataaattggtagaagattccgtactcactcctcatagtaatacatcacagactagtctcaacaacatcttcaataaaaaattacacgtcaaaatcgaaaacaaatcccacgtcgccggacaggtgttggaactgaccaagatgacgctgaaagattccctttgggaaccgcgccgccattccgacatccatacgctggaaacttccgataatgcccgcatccgcctgaacacgaaagatgaaaaactgaccgtccataaggattatgcgggcggcgcggatttcctgttcggctacgacgtgcgggagtcggacgaacccgccctgacctttgaagacaaagtcagcggacaatccggcgtggttttggaacgccggccggaaaatctgaaaacgctcgacgggcgcaaactgattgcggcaaaaacggcggattccggttcgtttgcgtttaaacaaaattaccggcagggactgtacgaattattgctcaagcaatgcgaaggcggattttgcttgggcgtgcagcgtttggctatccccgaggcggaagcggttttatatgcccaacaggcttatgcggcaaatactttgtttgggctgcgtgccgccgacaggggcgacgacgtgtatgccgccgatccgtcccgtcaaaaattgtggctgcgcttcatcggcggccggtcgcatcaaaatatacggggcggcgcggctgcggacgggtggcgcaaaggcgtgcaaatcggcggcgaggtgtttgtacggcaaaatgaaggcagccgactggcaatcggcgtgatgggcggcagggccggccagcacgcatcagtcaacggcaaaggcggtgcggcaggcagtgatttgtatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcattgtcggaaaaggcaataatgtgcggttttacctacaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcactcgaagggcggttcggtattgaagccggttggaaaggccatatgtccgcacgcatcggatatggcaaaaggacggacggcgacaaagaagccgcattgtcgctcaaatggctgttttga

SEQ ID NO: 2992 - protein, 619 aa, Neisseria meningitidis
MFRAQLGSNTRSTKIGDDADFSFSDKPKPGTSHYFSSGKTDQNSSEYGYDEINIQGKNYNSGILAVDNMPVVKKYITEKYGADLKQAVKSQLQDLYKTRPEAWAENKKRTEEAYIAQFGTKFSTLKQTMPDLINKLVEDSVLTPHSNTSQTSLNNIFNKKLHVKIENKSHVAGQVLELTKMTLKDSLWEPRRHSDIHTLETSDNARIRLNTKDEKLTVHKDYAGGADFLFGYDVRESDEPALTFEDKVSGQSGVVLERRPENLKTLDGRKLIAAKTADSGSFAFKQNYRQGLYELLLKQCEGGFCLGVQRLAIPEAEAVLYAQQAYAANTLFGLRAADRGDDVYAADPSRQKLWLRFIGGRSHQNIRGGAAADGWRKGVQIGGEVFVRQNEGSRLAIGVMGGRAGQHASVNGKGGAAGSDLYGYGGGVYAAWHQLRDKQTGAYLDGWLQYQRFKHRINDENRAERYKTKGWTASVEGGYNALVAEGIVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSARIGYGKRTDGDKEAALSLKWLF

SEQ ID NO: 2993 - DNA, 1860 bp, Neisseria meningitidis
atgttcagagctcagcttggttcaaatactcgttctaccaaaatcggcgacgatgccgatttttcattttcagacaagccgaaacccggcacttcccattatttttccagcggtaaaaccgatcaaaattcatccgaatatgggtatgacgaaatcaatatccaaggtaaaaactacaatagcggcatactcgccgtcgataatatgcccgttgttaagaaatatattacagatacttacggggataatttaaaggatgcggttaagaagcaattacaggatttatacaaaacaagacccgaagcttgggaagaaaataaaaaacggactgaggaggcgtatatagaacagcttggaccaaaatttagtatactcaaacagaaaaaccccgatttaattaataaattggtagaagattccgtactcactcctcatagtaatacatcacagactagtctcaacaacatcttcaataaaaaattacacgtcaaaatcgaaaacaaatcccacgtcgccggacaggtgttggaactgaccaagatgacgctgaaagattccctttgggaaccgcgccgccattccgacatccatatgctggaaacttccgataatgcccgcatccgcctgaacacgaaagatgaaaaactgaccgtccataaagcgtatcagggcggtgcggatttcctgttcggctacgacgtgcgggagtcggacaaacccgccctgacctttgaagaaaaagtcagcggacaatccggcgtggttttggaacgccggccggaaaatctgaaaacgctcgacgggcgcaaactgattgcggcggaaaaggcagactctaattcgtttgcgtttaaacaaaattaccggcagggactgtacgaattattgctcaagcaatgcgaaggcggattttgcttgggcgtgcagcgtttggctatccccgaggcggaagcggttttatatgcccaacaggcttatgcggcaaatactttgttcgggctgcgtgccgccgacaggggcgacgacgtgtatgccgccgatccgtcccgtcaaaaattgtggctgcgcttcatcggcggccggtcgcatcaaaatatacggggcggcgcggctgcggacgggcggcgcaaaggcgtgcaaatcggcggcgaggtgtttgtacggcaaaatgaaggcagccggctggcaatcggcgtgatgggcggcagggctggccagcacgcatcagtcaacggcaaaggcggtgcggcaggcagttatttgcatggttatggcgggggtgtttatgctgcgtggcatcagttgcgcgataaacaaacgggtgcgtatttggacggctggttgcaataccaacgtttcaaacaccgcatcaatgatgaaaaccgtgcggaacgctacaaaaccaaaggttggacggcttctgtcgaaggcggctacaacgcgcttgtggcggaaggcgttgtcggaaaaggcaataatgtgcggttttacctgcaaccgcaggcgcagtttacctacttgggcgtaaacggcggctttaccgacagcgaggggacggcggtcggactgctcggcagcggtcagtggcaaagccgcgccggcattcgggcaaaaacccgttttgctttgcgtaacggtgtcaatcttcagccttttgccgcttttaatgttttgcacaggtcaaaatctttcggcgtggaaatggacggcgaaaaacagacgctggcaggcaggacggcgctcgaagggcggttcggcattgaagccggttggaaaggccatatgtccgcacgcatcggatacggcaaaaggacggacggcgacaaagaagccgcattgtcgctcaaatggctgttttga

SEQ ID NO: 2994 - protein, 619 aa, Neisseria meningitidis
MFRAQLGSNTRSTKIGDDADFSFSDKPKPGTSHYFSSGKTDQNSSEYGYDEINIQGKNYNSGILAVDNMPVVKKYITDTYGDNLKDAVKKQLQDLYKTRPEAWEENKKRTEEAYIEQLGPKFSILKQKNPDLINKLVEDSVLTPHSNTSQTSLNNIFNKKLHVKIENKSHVAGQVLELTKMTLKDSLWEPRRHSDIHMLETSDNARIRLNTKDEKLTVHKAYQGGADFLFGYDVRESDKPALTFEEKVSGQSGVVLERRPENLKTLDGRKLIAAEKADSNSFAFKQNYRQGLYELLLKQCEGGFCLGVQRLAIPEAEAVLYAQQAYAANTLFGLRAADRGDDVYAADPSRQKLWLRFIGGRSHQNIRGGAAADGRRKGVQIGGEVFVRQNEGSRLAIGVMGGRAGQHASVNGKGGAAGSYLHGYGGGVYAAWHQLRDKQTGAYLDGWLQYQRFKHRINDENRAERYKTKGWTASVEGGYNALVAEGVVGKGNNVRFYLQPQAQFTYLGVNGGFTDSEGTAVGLLGSGQWQSRAGIRAKTRFALRNGVNLQPFAAFNVLHRSKSFGVEMDGEKQTLAGRTALEGRFGIEAGWKGHMSARIGYGKRTDGDKEAALSLKWLF

SEQ ID NO: 2995 - DNA, 702 bp, Neisseria gonorrhoeae
atgttcagacggcatcggcatttgaaaaatatgcagattaaaaaaatcatgaaatggcttcccgtcgccctgtcgcttttgggcgcgttgggttatacgggatatgacagtgaggcggtgcggacggcggttgccgtactcgacgtactcggcactgcaggggacgtgggtttcgacgcgcccgttcgccgacgggcatcggcgaaatccggccacagctacacaggcacggtgtccaaagtctatgacggcgatacccttcacgtcatcgacggcgacggcgcgaaacataaaattcggatggcgtatatcgacgcaccggagatgaaacaggcttacggtacacgttcgcgcgacaacctgcgcgcggcggcggagggtaggaaagtcagtgtacgtgtgtttgaaaccgaccgctatcagcgcgaagtggcgcaggtatccgccggcaaaaccgatttgaacctgatgcaggtgcaggacggggcggcgtggcattataaaagttatgctaaagaacagcaggataaggcggattttgccgactatgccgacgctcaaattcaggcggaaagggaacgcaaaggattgtggaaagctaaaaatccgcaagcgccgtgggcgtaccgccgggcaggcaggagcggcgggggcaataaggattggatggattccgtgggcgaatggttgggcatttggtaa

SEQ ID NO: 2996 - protein, 233 aa, Neisseria gonorrhoeae
MFRRHRHLKNMQIKKIMKWLPVALSLLGALGYTGYDSEAVRTAVAVLDVLGTAGDVGFDAPVRRRASAKSGHSYTGTVSKVYDGDTLHVIDGDGAKHKIRMAYIDAPEMKQAYGTRSRDNLRAAAEGRKVSVRVFETDRYQREVAQVSAGKTDLNLMQVQDGAAWHYKSYAKEQQDKADFADYADAQIQAERERKGLWKAKNPQAPWAYRRAGRSGGGNKDWMDSVGEWLGIW

SEQ ID NO: 2997 - DNA, 702 bp, Neisseria meningitidis
atgttcagacggcatcggcatttgaaaaatatgcagattaaaaaaatcatgaaatggcttcccgtcgccctgtcgcttttgggtgcgttgggttatacggggtacggcagcgaggcggtgcggacggcggttgccgtactcgacgtactcggcgcggcaggggacgcgggttccgacgcgcccgcccgccgccgagcatcggcgaaatccggccaccgctacacaggcacggtgtccaaagtctatgacggcgacacccttcacgttatcgacggcgacggcgcgaaacacaaaatccggatggcgtatatcgacgcgccggagatgaaacaggcttacggcacgcgttcgcgcgacaacctgcgcgcggcggcggaaggcaggaaagtcagcgtgcgcgtgttcgataccgaccgctaccagcgcgaagtggcgcaggtttctgtcggcaaaaccgatttgaacctgatgcaggtgcaggacggggcggcgtggcattataaaagttatgctaaagaacagcaggataaggcggattttgccgattatgccgacgctcaaattcaggcggaaagggaacgcaaaggattgtggaaagctaaaaatccgcaagcgccgtgggcgtaccgccgagcaggcaggagcggcgggggcaataaggattggatggatgccgtgggcgaatggttgggcatttggtaa

SEQ ID NO: 2998 - protein, 233 aa, Neisseria meningitidis
MFRRHRHLKNMQIKKIMKWLPVALSLLGALGYTGYGSEAVRTAVAVLDVLGAAGDAGSDAPARRRASAKSGHRYTGTVSKVYDGDTLHVIDGDGAKHKIRMAYIDAPEMKQAYGTRSRDNLRAAAEGRKVSVRVFDTDRYQREVAQVSVGKTDLNLMQVQDGAAWHYKSYAKEQQDKADFADYADAQIQAERERKGLWKAKNPQAPWAYRRAGRSGGGNKDWMDAVGEWLGIW

SEQ ID NO: 2999 - DNA, 700 bp, Neisseria meningitidis
atgttcagacggcatcggcatttgaaaaatatgcagattaaaaaaatcatgaaatggcttcccgtcgccttgtcgcttttgggtgcgttgggttatacggggtacggcagcgaggcggtgcggacggcggttgccgtactcgacgtactcggcgcggcaggggacgcgggttccgacgcgcccgcccgccgccgagcatcggcgaaatccggccaccgctacacaggcacggtgtccaaagtctatgacggcgacacccttcacgttatcgacggcgacggcgcgaaacacaaaatccggatggcgtatatcgacgcgccggagatgaaacaggcttacggcacgcgttcgcgcgacaacctgcgcgcggcggcggaaggcaggaaagtcagcgtccgcgtgttcgacaccgaccgctaccagcgcgaagtggcgcaggtttctgtcggcaaaaccgatttgaacctgatgcaggtgcaggacggggcggcgtggcattataaaagttatgctaaagaacagcaggataaggcggattttgccgattatgccgacgctcaaattcaggcggaaagggaacgcaaaggattgtggaaagctaaaaatccgcaagcgccgtgggcgtaccgccgggcaggcaggagcggcgggggcaataaggattggatggatgccgtgggcgaatggttgggcatttggt

SEQ ID NO: 3000 - protein, 233 aa, Neisseria meningitidis; identical to SEQ ID NO: 2998

SEQ ID NO: 3001 - DNA, 747 bp, Neisseria gonorrhoeae
ctgaaagtcgtattgggcagttttcaaggccctttggatctgctgctctaccttatccgcaagcagaacatcgatgttctcgatattccgatggtggaaattaccgggcagtatctgcactatattgcccaaatggaagcctatcagtttgatttggcggcggaatatcttttgatggcggcaatgctgattgaaatcaaatcgcgcctgctgctgccgcgtaccgaagccgtcgaagacgaagaggccgacccgcgtgccgagttggtgcgccgtctgcttgcctacgagcaaatgaaactggcggcgcagggtttggacgcgctgccgcgtgcgggacgggatttcgcgtgggcttacctgccgctggaaattgcagccgagacgaagctgcccgaggtttacatcgccgatttgatgcaggcatggttgggcattctttctcgggcaaaacatacgcgcagccacgaagtaatccaagaaaccctttccgtgcgcgcgcaaatgacggcaatcctgcgccgtttgaacgaacacgggatatgcaggtttcacgccctgttcaatcccgaacagggcgcggcttacgtgatcgtcaacttcatcgccctgttggagcttgccaaagaaggattggtcggaatcgtacaggaagacggtttcggagaaatccgaatcagcctcaatcatgagggggcgcattcagacggcattttcggcacacggggcgggcgcgatgtgttctaa

SEQ ID NO: 3002 - protein, 248 aa, Neisseria gonorrhoeae
LKVVLGSFQGPLDLLLYLIRKQNIDVLDIPMVEITGQYLHYIAQMEAYQFDLAAEYLLMAAMLIEIKSRLLLPRTEAVEDEEADPRAELVRRLLAYEQMKLAAQGLDALPRAGRDFAWAYLPLEIAAETKLPEVYIADLMQAWLGILSRAKHTRSHEVIQETLSVRAQMTAILRRLNEHGICRFHALFNPEQGAAYVIVNFIALLELAKEGLVGIVQEDGFGEIRISLNHEGAHSDGIFGTRGGRDVF

SEQ ID NO: 3003 - DNA, 747 bp, Neisseria meningitidis
ttgaaagtcgtattgggcagcttccaaggccctttggatctactgctgtatctgatccgcaaacagaatatcgacgtactggatattccgatggtgaagattaccgagcagtatctgcactacatcgcccaaatagaaacctatcagtttgatttggcggcggaatatcttttgatggcagcaatgctgattgaaatcaaatcgcgcctgctgctgccgcgtaccgaaaccgtcgaagacgaagaagccgacccgcgtgccgagttggtgcgccgcctgctggcttacgaacagatgaagctggcggcgcagggtttggacgcgctgccccgagccggacgggatttcgcgtgggcttacctgccgctggaaattgccgtcgaagccaagctgcccgaagtctatattaccgacttgacgcaagcgtggctgggtattttgtctcgggcaaaacacacgcgcagccacgaagtaatcaaagaaaccatctccgtgcgcgcgcaaatgacggcaatcctgcgccgtttgaacggacacggaatatgcaggtttcacgacctgttcaatcccaaacagggcgcggcttacgtggtcgtcaacttcatcgcactgttggagcttgccaaagaaggattggtcagaatcgtgcaggaagacggtttcggagaaatccgaatcagcctcaatcatgagggggcgcattcagacggcatttccggcacacgaggcgggcgcgatgtgttctaa

SEQ ID NO: 3004 - protein, 248 aa, Neisseria meningitidis
LKVVLGSFQGPLDLLLYLIRKQNIDVLDIPMVKITEQYLHYIAQIETYQFDLAAEYLLMAAMLIEIKSRLLLPRTETVEDEEADPRAELVRRLLAYEQMKLAAQGLDALPRAGRDFAWAYLPLEIAVEAKLPEVYITDLTQAWLGILSRAKHTRSHEVIKETISVRAQMTAILRRLNGHGICRFHDLFNPKQGAAYVVVNFIALLELAKEGLVRIVQEDGFGEIRISLNHEGAHSDGISGTRGGRDVF

SEQ ID NO: 3005 - DNA, 747 bp, Neisseria meningitidis
ctgaaagtcgtattgagcagttttcaaggccctttggatctgctgctctaccttatccgcaagcagaacatcgatgttctcgatattccgatggtgaagattaccgaacagtatctgcactacatcgcccaaatagaaacctatcagtttgatttggcggcggaatatcttttgatggcagcaatgctgattgaaatcaaatcgcgcctgctgctgccgcgtaccgaaaccgtcgaagacgaagaagccgacccgcgtgccgagttggtgcgccgcctgctggcttacgagcagatgaagctggcggcacaagggttggatgcgcttcctcgtgcgggccgggatttcgcatgggcatacctgccactggaaattgccgtcgaagccaagctgcccgaagtctatattaccgacttgacgcaggcgtggctgagtattttgtctcgggcaaaacatacgcgcagccacgaagttatcaaagaaaccatctccgtgcgcgcgcaaatgacggcaatcctgcgccgtttgaacaaacacgggatatgcaggtttcacgacctgttcaatcccgaacagggcgcggcttacgtggtcgtcaacttcatcgcactgttggagcttgccaaagaaggtttggtcggaatcgtacaggaagtcggtttcggagaaatccgaatcagcctcaatcatgagggggcgcattcagacggcatttccggcacacggggcgggcgcgatgtgttctaa

SEQ ID NO: 3006 - protein, 248 aa, Neisseria meningitidis
LKVVLSSFQGPLDLLLYLIRKQNIDVLDIPMVKITEQYLHYIAQIETYQFDLAAEYLLMAAMLIEIKSRLLLPRTETVEDEEADPRAELVRRLLAYEQMKLAAQGLDALPRAGRDFAWAYLPLEIAVEAKLPEVYITDLTQAWLSILSRAKHTRSHEVIKETISVRAQMTAILRRLNKHGICRFHDLFNPEQGAAYVVVNFIALLELAKEGLVGIVQEVGFGEIRISLNHEGAHSDGISGTRGGRDVF

SEQ ID NO: 3007 - DNA, 624 bp, Neisseria gonorrhoeae
atgaacagaagaaccttcctcctcggcgcaggcgcgttgcttcttaccgcctgcggcagaaaatccgcccgaacccacgccaaaattcccgaaggaagcaccgtgcttgccttgggcgattcgctcaccttcggctacggagcaaaccccggcgaatcctaccccgcgcaactgcaaaaactgacgggttggaatattgtcaacggcggcgtatcgggcgatacgtccgcgcaagccctatcgcgcctgcccgcgctgttggcacgcaaacccaagcttgtgattgtcggcataggcggcaacgactttctgcgcaaagttcccgaggagcagacccgcgccaatatcgcgaaaatcatcgaaaccgtgcaaaaggaaaacattcccgccgtcctcgtcggcgtgccgcacatcacactgggcgcgttgttcgggcatttgagcgaccatccgctgtatgaggatttgtccgaggaatacggcattccgttgttcggcggcgcgtgggcggaaattttgggcaataataatctgaaatccgaccaaatccacgccaacggcaaaggctatcggaaattcgccgaaaatttgaatcaatttttgagaaaacatgggtttagataa

SEQ ID NO: 3008 - protein, 200 aa, Neisseria gonorrhoeae
MNRRTFLLGAGALLLTACGRKSARTHAKIPEGSTVLALGDSLTFGYGANPGESYPAQLQKLTGWNIVNGGVSGDTSAQALSRLPALLARKPKLVIVGIGGNDFLRKVPEEQTRANIAKIIETVQKENIPAVLVGVPHITLGALFGHLSDHPLYEDLSEEYGIPLFGGAWAEILGNNNLKSDQIHANGKGYRKFAENLNQF

SEQ ID NO: 3009 - DNA, 624 bp, Neisseria meningitidis
atgaacagaagaaccttcctcctcggcgcaggcgcgttgctgcttaccgcctgcggcagaaaatccgcccgaacccacgccaaaattcccgaaggaagcaccgtacttgccttgggcgattcgcttaccttcggctacggcgcaaaccctggcgaatcctaccccgcgcaactgcaaaaactgacgggttggaatattgtcaacggcggcgtatcgggcgatacatctgcccaagccctgtcgcgcctgcccgcgctgttggcacgcaaacccaagcttgtgattgtcggcataggcggcaacgactttctgcgcaaagttcccaaggagcagacccgcgccaatatcgcgaaaatcatcgaaaccgtgcagaaggaaaacatccccgccgtcctcgtcggcgtgccgcacatcacactgggtgcgttgttcgggcatttgagcgatcatccgctgtatgaggatttgtccgaggaatacggcattccgctgttcggcggcgcgtgggcggaaattttgggcgataataatctgaaatccgaccaaatccacgccaacggcaaaggctatcggaaatttgccgaagatttgaatcaatttttgagaaaacaggggtttagataa

SEQ ID NO: 3010 - protein, 207 aa, Neisseria meningitidis
MNRRTFLLGAGALLLTACGRKSARTHAKIPEGSTVLALGDSLTFGYGANPGESYPAQLQKLTGWNIVNGGVSGDTSAQALSRLPALLARKPKLVIVGIGGNDFLRKVPKEQTRANIAKIIETVQKENIPAVLVGVPHITLGALFGHLSDHPLYEDLSEEYGIPLFGGAWAEILGDNNLKSDQIHANGKGYRKFAEDLNQFLRKQGFR

SEQ ID NO: 3011 - DNA, 624 bp, Neisseria meningitidis
atgaacagaagaaccttcctcctcggcgcaggcgcgttgctccttaccgcctgcggcagaaaatccgcccgaacccacgccaaaattcccgaaggaagcaccgtacttgccttgggcgattcgcttaccttcggctacggcgcaaaccccggcgaatcctaccccgcgcaactgcaaaaactgacgggttggaatattgtcaacggcggcgtatcgggcgatacatccgcccaagccctgtcgcgcctgcccgcgctgttggcacgcaaacccaagcttgtgattgtcggcataggcggcaacgactttctgcgcaaagttcccaaggagcagacccgcgccaatatcgcgaaaatcatcgaaaccgtgcagaaggaaaacatccccgccgtcctcgtcggcgtgccgcacattaccttgggcgcgttgttcgggcatttgagcgatcatccgctgtatgaggatttgtccgaggaatacggcattccgctgttcggcggcgcgtgggcggaaattttgggcgataataatctgaaatccgaccaaatccacgccaacggcaaaggctatcggaaatttgccgaagatttgaatcaatttttgagaaaacaggggtttagataa

SEQ ID NO: 3012 - protein, 207 aa, Neisseria meningitidis; identical to SEQ ID NO: 3010

SEQ ID NO: 3013 - DNA, 1053 bp, Neisseria gonorrhoeae
atgatgaacacgccgcatccgcgcccgaaaatcgccgtcatcggcgcaggctgggccggcttgtccgccgccgtcaccttggcgcggcacgccgacgttaccctgtttgaagccggccggcaggcgggcggaagggcgcgcacactggccggaaataccgacggtttcggttttttggacaacgggcagcacattttgctcggcgcataccggggcgtgttgcgcctgatgaaaaccatcggttcagacccccgtgccgcctttttgcgcgtaccgctgcactggcatatgcacggcggtttgcagttccgcgccctccccctgcccgcgccgctgcatattttgggcggcgtgctgcttgcccggcgcgtaccgtccgcattcaaagccaaactgcttgccgatatgtccgatttgcagaagtccgcacgcctcggacagcccgacacgacagttgcacaatggctgaaacagcggaacgtgccgcgtgccgccgtaatgcagttttggcagcccttggtctggggcgcgctcaacacgcctttggaaaccgcaagcctgcgcgtgttgtgcaacgttttgtccgacggcgtgctgacgaaaaaatccggcagcgactatctcctacccaaacaggatttgggcgcaatcgtcgccgaacccgccttggcggagcttcaacggctcggcgcggacatccgcctcgaaacgcgcgtatgccgtctgaacaccctcccggacggaaaagtcctcgtcaacggcgaagccttcgatgccgccatacttgccaccgcgccctaccacgccgccgcgctcctgcccgaaggcacgcccgaacacgttcagacggcatatcaaaaccttcgctaccacgccatcaccaccgtctatctgcgctacgccgaacccgtccgcctgcccgccccgctgaccggcattgccgacggcacggcacaatggctgctttgcccggggcaggctccggactgcccccaaaacgaagtctccgccgtcattagcgtttccgaccgcgtcggcgcgtttgcaaaccga

SEQ ID NO: 3014 - protein, 351 aa, Neisseria gonorrhoeae
MMNTPHPRPKIAVIGAGWAGLSAAVTLARHADVTLFEAGRQAGGRARTLAGNTDGFGFLDNGQHILLGAYRGVLRLMKTIGSDPRAAFLRVPLHWHMHGGLQFRALPLPAPLHILGGVLLARRVPSAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALAELQRLGADIRLETRVCRLNTLPDGKVLVNGEAFDAAILATAPYHAAALLPEGTPEHVQTAYQNLRYHAITTVYLRYAEPVRLPAPLTGIADGTAQWLLCPGQAPDCPQNEVSAVISVSDRVGAFANR

SEQ ID NO: 3015 - DNA, 1314 bp, Neisseria meningitidis
atgatgaacacgccgcatccgcgcccgaaaatcgccgtcatcggcgcaggctgggcaggactgtccgccgccgtcaccttggcgcggcacgccgacgttaccctgtttgaagccggccggcaggcgggcggcagggcgcgcacactggccggaaataccgacggtttcggttttttggacaacgggcagcacattttgctcggcgcataccggggcgtgttgcgcctgatgaaaaccatcggttcggatccccgtgccgcctttttgcgcgtaccgctgcactggcatatgcacggcggtttgcagttccgcgccctccccctgcccgcgccgctgcatattttgggcggcgtgctgcttgcccggcgtgcaccgactgcattcaaagccaaactgcttgccgatatgtccgatttgcagaagtccgcacgcctcggacagcccgacacgacagtggcgcaatggctgaaacagcggaacgtgccgcgtgccgccgtgatgcagttttggcagcccttggtttggggcgcgctcaacacgcctttggaaaccgcaagcctgcgcgtgttgtgcaacgttttgtccgacggcgtgctgacgaaaaaatccggcagcgactatctcctacccaagcaggatttgggcgcaatcgtcgccgaacccgccttggcggatcttcaacggctcggcgcggacatccgcctcgaaacgcgcgtatgccgtctgaacaccctcccggacgggaaagtgctcgtcaacggcgaagctttcgatgccgccgtccccgccaccgcgccctaccacgccgccgcgctcctgcccgaaggcacgcccgaacacgttcagacggcatatcaaaaccttcgctaccacgccatcaccaccgtctatctgcgctacgccgaacccgtccgcctgcccgccccgctgaccggccttgccgacggcacggtgcaatggctgctttgccggggcaggctcggactgcctgaaaacgaagtgtccgccgtcatcagcgtttccgaccgcgtcggcgcgtttgcaaaccgggcgtgggcggacaaagcccacgccgacctcaaacgcatccttccgcatttgggcgaacccgaagccgtgcgcgtcatcaccgaaaaacgcgccacaaccgcagccgatgccccgccgccggacttgtcgtggttgcaccggcaccgcatcttccccgccggcgactacctccacccggactaccccgccacgctcgaagccgccgtacaatcaggtttcgcgtcggcggaagcctgcctgcaaagcctgagcgatgccgtctga

SEQ ID NO: 3016 - protein, 437 aa, Neisseria meningitidis
MMNTPHPRPKIAVIGAGWAGLSAAVTLARHADVTLFEAGRQAGGRARTLAGNTDGFGFLDNGQHILLGAYRGVLRLMKTIGSDPRAAFLRVPLHWHMHGGLQFRALPLPAPLHILGGVLLARRAPTAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALADLQRLGADIRLETRVCRLNTLPDGKVLVNGEAFDAAVPATAPYHAAALLPEGTPEHVQTAYQNLRYHAITTVYLRYAEPVRLPAPLTGLADGTVQWLLCRGRLGLPENEVSAVISVSDRVGAFANRAWADKAHADLKRILPHLGEPEAVRVITEKRATTAADAPPPDLSWLHRHRIFPAGDYLHPDYPATLEAAVQSGFASAEACLQSLSDAV

SEQ ID NO: 3017 - DNA, 1314 bp, Neisseria meningitidis
atgatgaacacgccgcatccgcgcccgaaaatcgccgtcatcggcgcaggctgggccggcttgtccgccgccgttaccttggcgcggcacgccgacgttaccctgtttgaagccggccggcaggcgggcggcagggcgcgcgcactggccggaaataccgacggtttcggttttttggacaacgggcagcatattttactcggcgcataccggggcgtgttgcgcctgatgaaaaccatcggttcagacccccatgccgcctttttgcgcgtaccgctgcactggcatatgcacggcggtttgcagttccgcgccctccccctgcccgcgcccctgcatattttgggcggcgtgctgcttgcccggcgcgtaccgtccgcattcaaagccaaactgcttgccgatatgtccgatttgcagaagtccgcacgcctcggacagcccgacacgacagtggcgcaatggctgaaacagcggaacgtgccgcgtgccgccgtaatgcagttttggcagcccttggtttggggcgcgctcaacacgcctttggaaaccgcaagcctgcgcgtgttgtgcaacgttttgtccgacggcgtgctgacgaaaaaatccggcagcgactatctcctacccaaacaggatttgggcgcaatcgtcgccgaacccgccttggcggagcttcaacggctcggcgcggacatccgcctcgaaacgcgcatatgccgtctgaacaccctcccggacgggaaagtgctcgtcaacggcgaacctttcgatgccgccgtccccgccaccgcgccctaccacgccgccgcgctcctgcccgaaggcacgcccgaacacgttcagacggcatatcaaaaccttcgctatcacgccatcaccaccgtctatctgcgctatgccgaacccgtccgcttgcctgccccgctgaccggacttgccgacggcacggtgcaatggctgctttgccggggcaggctcggactgcctgaaaacgaagtgtccgccgtcatcagcgtttccgaccgcgtcggcgcgtttgcaaaccgggcgtgggcggacaaagttcacgccgacctcaaacgcatccttccgcatttgggcgaacccgaagccgtgcgcgtcatcaccgaaaaacgcgccacaaccgcagccgatgccccgccgccggatttgtcgtggttgcaccggcaccgcatcttccccgccggcgactacctccacccagactaccccgccacgctcgaagccgccgtacaatcaggtttcgcgtcggcggaagcctgcctgcaaagcctgagcgatgccgtctga

SEQ ID NO: 3018 - protein, 437 aa, Neisseria meningitidis
MMNTPHPRPKIAVIGAGWAGLSAAVTLARHADVTLFEAGRQAGGRARALAGNTDGFGFLDNGQHILLGAYRGVLRLMKTIGSDPHAAFLRVPLHWHMHGGLQFRALPLPAPLHILGGVLLARRVPSAFKAKLLADMSDLQKSARLGQPDTTVAQWLKQRNVPRAAVMQFWQPLVWGALNTPLETASLRVLCNVLSDGVLTKKSGSDYLLPKQDLGAIVAEPALAELQRLGADIRLETRICRLNTLPDGKVLVNGEPFDAAVPATAPYHAAALLPEGTPEHVQTAYQNLRYHAITTVYLRYAEPVRLPAPLTGLADGTVQWLLCRGRLGLPENEVSAVISVSDRVGAFANRAWADKVHADLKRILPHLGEPEAVRVITEKRATTAADAPPPDLSWLHRHRIFPAGDYLHPDYPATLEAAVQSGFASAEACLQSLSDAV

SEQ ID NO: 3019 - DNA, 603 bp, Neisseria meningitidis
atgaatatgaaaaaattgatttccgcaatttgtgtttcaattgttttatcagcctgcaaccaacaatcaaaaacggcacaagccgaagaacctgtccaaagtatccaggctgctgattgtaccgccccaatggacatcacagttgaacaatatctcatcaatttggagcaagcatttaaaactcagaacgtctcaacaaaaatccataataaaaatattgtcaagaccgattgtggttatgaccttactttggtaatggattttggggcgattgcgctcaaactggacgagcagcaaaaaattagagctatctcagtaggctacattttaaaaaccgacggagagaaaggacaaaatctagtcaataatgccataaatggattacacagtattcaggcagttctgtctttaactaccacagacaaattgggcgaatcggaagcaggaaaacaactttttacagctttaaccgaagtcgtcaaagaatccaatcagacaggagcaacagcgcaaaaagacgttccggcagatggtattttatatagcgttgtttttgaaaaagaaacaaacaccattgcaataatcggcagaaaacaaccctaa

SEQ ID NO: 3020 - protein, 200 aa, Neisseria meningitidis
MNMKKLISAICVSIVLSACNQQSKTAQAEEPVQSIQAADCTAPMDITVEQYLINLEQAFKTQNVSTKIHNKNIVKTDCGYDLTLVMDFGAIALKLDEQQKIRAISVGYILKTDGEKGQNLVNNAINGLHSIQAVLSLTTTDKLGESEAGKQLFTALTEVVKESNQTGATAQKDVPADGILYSVVFEKETNTIAIIGRKQP

SEQ ID NO: 3021 - DNA, 1194 bp, Neisseria gonorrhoeae; identical to SEQ ID NO: 987

SEQ ID NO: 3022 - DNA, 33 bp, Artificial Sequence
  Description of Artificial Sequence: Primers
cgcggatcccatatgttgcctgcaatcacgatt

SEQ ID NO: 3023 - protein, 28 aa, Artificial Sequence
  Description of Artificial Sequence: Primers
CCCGCTCGAGTTTAGAAGCGGGCGGCAA

SEQ ID NO: 3024 - DNA, 34 bp, Artificial Sequence
  Description of Artificial Sequence: Primers
cgcggatcccatatgttcaaatcctttgtcgtca

SEQ ID NO: 3025 - protein, 27 aa, Artificial Sequence
  Description of Artificial Sequence: Primers
CCCGCTCGAGTTTGGCGGTTTTGCTGC

SEQ ID NO: 3026 - DNA, 30 bp, Artificial Sequence
  Description of Artificial Sequence: Primers
cgcggatcccatatggccgcccccgcatct

SEQ ID NO: 3027 - protein, 31 aa, Artificial Sequence
  Description of Artificial Sequence: Primers
CCCGCTCGAGATTTACTTTTTTGATGTCGAC

SEQ ID NO: 3028 - DNA, 33 bp, Artificial Sequence
  Description of Artificial Sequence: Primers
cgcggatcccatatgtgccaaagcaagagcatc

SEQ ID NO: 3029 - protein, 25 aa, Artificial Sequence
  Description of Artificial Sequence: Primers
CCCGCTCGAGCGGGCGGTATTCGGG

SEQ ID NO: 3030 - DNA, 32 bp, Artificial Sequence
  Description of Artificial Sequence: Primers
cgcggatcccatatggaaacacagctttacat

SEQ ID NO: 3031 - protein, 29 aa, Artificial Sequence
  Description of Artificial Sequence: Primers
CCCGCTCGAGATAATAATATCCCGCGCCC

SEQ ID NO: 3032 - DNA, 29 bp, Artificial Sequence
  Description of Artificial Sequence: Primers
cgcggatcccatatgactgacaacgcact

SEQ ID NO: 3033 - protein, 26 aa, Artificial Sequence
  Description of Artificial Sequence: Primers
CCCGCTCGAGGACCGCGTTGTCGAAA

SEQ ID NO: 3034 - DNA, 31 bp, Artificial Sequence
  Description of Artificial Sequence: Primers
cgcggatcccatatgaaacaccgccaaccga

SEQ ID NO: 3035 - protein, 31 aa, Artificial Sequence
  Description of Artificial Sequence: Primers
CCCGCTCGAGTTCTGTAAAAAAAGTATGTGC

SEQ ID NO: 3036 - DNA, 32 bp, Artificial Sequence
  Description of Artificial Sequence: Primers
ccggaattctagctagcctttcagcctgcggg

SEQ ID NO: 3037 - protein, 28 aa, Artificial Sequence
  Description of Artificial Sequence: Primers
CCCGCTCGAGATCCTGCTCTTTTTTGCC

SEQ ID NO: 3038 - DNA, 31 bp, Artificial Sequence
  Description of Artificial Sequence: Primers
cgcggatcccatatgtgcgggacactgacag

SEQ ID NO: 3039 - protein, 28 aa, Artificial Sequence
  Description of Artificial Sequence: Primers
CCCGCTCGAGAGGTTGTCCTTGTCTATG

SEQ ID NO: 3040 - DNA, 459 bp, Neisseria meningitidis; identical to SEQ ID NO: 1147

SEQ ID NO: 3041 - protein, 152 aa, Neisseria meningitidis; identical to SEQ ID NO: 1148

SEQ ID NO: 3042 - DNA, 459 bp, Neisseria gonorrhoeae; identical to SEQ ID NO: 1145

SEQ ID NO: 3043 - protein, 152 aa, Neisseria meningitidis; identical to SEQ ID NO: 1146

SEQ ID NO: 3044 - DNA, 459 bp, Neisseria meningitidis; identical to SEQ ID NO: 1149
  misc_feature (6)..(6): n is a, c, g, or t
  misc_feature (8)..(8): n is a, c, g, or t
  misc_feature (38)..(39): n is a, c, g, or t
  misc_feature (96)..(96): n is a, c, g, or t
  misc_feature (102)..(102): n is a, c, g, or t
  misc_feature (341)..(341): n is a, c, g, or t
  misc_feature (390)..(390): n is a, c, g, or t
  misc_feature (410)..(410): n is a, c, g, or t

SEQ ID NO: 3045 - protein, 152 aa, Neisseria meningitidis; identical to SEQ ID NO: 1150
  misc_feature (3)..(3): Xaa can be any naturally occurring amino acid
  misc_feature (13)..(13): Xaa can be any naturally occurring amino acid
  misc_feature (114)..(114): Xaa can be any naturally occurring amino acid
  misc_feature (137)..(137): Xaa can be any naturally occurring amino acid

SEQ ID NO: 3046 - DNA, 600 bp, Neisseria meningitidis; identical to SEQ ID NO: 1449

SEQ ID NO: 3047 - protein, 199 aa, Neisseria meningitidis; identical to SEQ ID NO: 1450

SEQ ID NO: 3048 - DNA, 951 bp, Neisseria gonorrhoeae; identical to SEQ ID NO: 1447

SEQ ID NO: 3049 - protein, 316 aa, Neisseria gonorrhoeae; identical to SEQ ID NO: 1448

SEQ ID NO: 3050 - DNA, 948 bp, Neisseria meningitidis; identical to SEQ ID NO: 1451

SEQ ID NO: 3051 - protein, 315 aa, Neisseria meningitidis; identical to SEQ ID NO: 1452

SEQ ID NO: 3052 - DNA, 948 bp, Neisseria meningitidis; identical to SEQ ID NO: 1455

SEQ ID NO: 3053 - protein, 315 aa, Neisseria meningitidis; identical to SEQ ID NO: 1456

SEQ ID NO: 3054 - DNA, 948 bp, Neisseria gonorrhoeae; identical to SEQ ID NO: 1453

SEQ ID NO: 3055 - protein, 315 aa, Neisseria gonorrhoeae; identical to SEQ ID NO: 1454

SEQ ID NO: 3056 - DNA, 948 bp, Neisseria meningitidis; identical to SEQ ID NO: 1451

SEQ ID NO: 3057 - protein, 315 aa, Neisseria meningitidis; identical to SEQ ID NO: 1452

SEQ ID NO: 3058 - DNA, 669 bp, Neisseria meningitidis; identical to SEQ ID NO: 1739

SEQ ID NO: 3059 - protein, 222 aa, Neisseria meningitidis; identical to SEQ ID NO: 1740

SEQ ID NO: 3060 - DNA, 648 bp, Neisseria gonorrhoeae; identical to SEQ ID NO: 1737

SEQ ID NO: 3061 - protein, 215 aa, Neisseria gonorrhoeae; identical to SEQ ID NO: 1738

SEQ ID NO: 3062 - DNA, 819 bp, Neisseria meningitidis; identical to SEQ ID NO: 1741

SEQ ID NO: 3063 - protein, 272 aa, Neisseria meningitidis; identical to SEQ ID NO: 1742

SEQ ID NO: 3064 - DNA, 819 bp, Neisseria meningitidis; identical to SEQ ID NO: 1745

SEQ ID NO: 3065 - protein, 272 aa, Neisseria meningitidis; identical to SEQ ID NO: 1746

SEQ ID NO: 3066 - DNA, 819 bp, Neisseria gonorrhoeae; identical to SEQ ID NO: 1743

SEQ ID NO: 3067 - protein, 272 aa, Neisseria gonorrhoeae; identical to SEQ ID NO: 1744

SEQ ID NO: 3068 - DNA, 819 bp, Neisseria meningitidis; identical to SEQ ID NO: 1741

SEQ ID NO: 3069 - protein, 272 aa, Neisseria meningitidis; identical to SEQ ID NO: 1742

SEQ ID NO: 3070 - DNA, 1326 bp, Neisseria meningitidis; identical to SEQ ID NO: 2791

SEQ ID NO: 3071 - protein, 441 aa, Neisseria meningitidis; identical to SEQ ID NO: 2792

SEQ ID NO: 3072 - DNA, 1326 bp, Neisseria gonorrhoeae; identical to SEQ ID NO: 2789

SEQ ID NO: 3073 - protein, 441 aa, Neisseria gonorrhoeae; identical to SEQ ID NO: 2790

SEQ ID NO: 3074 - DNA, 1326 bp, Neisseria meningitidis; identical to SEQ ID NO: 2793

SEQ ID NO: 3075 - protein, 441 aa, Neisseria meningitidis; identical to SEQ ID NO: 2794

SEQ ID NO: 3076 - DNA, 858 bp, Neisseria meningitidis
  misc_feature (752)..(752): n is a, c, g, or t
  misc_feature (839)..(839): n is a, c, g, or t
atggaaacacagctttacatcggcatcatgtcgggaaccagcatggacggggcggatgccgtactgatacggatggacggcggcaaatggctgggcgcggaagggcacgcctttaccccctaccccggcaggttacgccgccaattgctggatttgcaggacacaggcgcagacgaactgcaccgcagcaggattttgtcgcaagaactcagccgcctatatgcgcaaaccgccgccgaactgctgtgcagtcaaaacctcgcaccgtccgacattaccgccctcggctgccacgggcaaaccgtccgacacgcgccggaacacggttacagcatacagcttgccgatttgccgctgctggcgcagcttccttacgacaaaaacggtgcaaagtcggcacaaggcaacatattgccgcaactgctcgacaggctgctcgcccacccgtatttcgcacaacgccaccctaaaagcacggggcgcgaactgtttgccataaattggctcgaaacctaccttgacggcggcgaaaaccgatacgacgtattgcggacgctttcccgttttaccgcgcaaaccgtttgcgacgccgtctcacacgcagcggcagatgcccgtcaaatgtacatttgcgacggcggcatccgcaatcctgttttaatggcggatttggcagaatgtttcggcacacgcgtttccctgcacagcaccgccgacctgaacctcgatccgcaatgggtggaagccgccgnatttgcgtggttggcggcgtgttggattaatcgcattcccggtagtccgcacaaagcaaccggcgcatccaaaccgtgtattctgancgcgggatattattattga

SEQ ID NO: 3077 - protein, 366 aa, Neisseria meningitidis; identical to SEQ ID NO: 438
  misc_feature (122)..(202): Xaa can be any naturally occurring amino acid
  misc_feature (332)..(332): Xaa can be any naturally occurring amino acid
  misc_feature (361)..(361): Xaa can be any naturally occurring amino acid

SEQ ID NO: 3078 - DNA, 1101 bp, Neisseria gonorrhoeae; identical to SEQ ID NO: 435

SEQ ID NO: 3079 - protein, 366 aa, Neisseria gonorrhoeae; identical to SEQ ID NO: 436

SEQ ID NO: 3080 - DNA, 1101 bp, Neisseria meningitidis; identical to SEQ ID NO: 439

SEQ ID NO: 3081 - protein, 366 aa, Neisseria meningitidis; identical to SEQ ID NO: 440

SEQ ID NO: 3082 - DNA, 1101 bp, Neisseria meningitidis; identical to SEQ ID NO: 441
  misc_feature (995)..(995): n is a, c, g, or t
  misc_feature (1082)..(1082): n is a, c, g, or t

SEQ ID NO: 3083 - protein, 366 aa, Neisseria meningitidis; identical to SEQ ID NO: 442
  misc_feature (332)..(332): Xaa can be any naturally occurring amino acid
  misc_feature (361)..(361): Xaa can be any naturally occurring amino acid

SEQ ID NO: 3084 - DNA, 1101 bp, Neisseria meningitidis; identical to SEQ ID NO: 439

SEQ ID NO: 3085 - protein, 366 aa, Neisseria meningitidis; identical to SEQ ID NO: 440

SEQ ID NO: 3086 - DNA, 1431 bp, Neisseria meningitidis; identical to SEQ ID NO: 483
  misc_feature (1216)..(1216): n is a, c, g, or t
  misc_feature (1334)..(1334): n is a, c, g, or t
  misc_feature (1347)..(1347): n is a, c, g, or t

SEQ ID NO: 3087 - protein, 426 aa, Neisseria meningitidis
  misc_feature (99)..(99): Xaa can be any naturally occurring amino acid
  misc_feature (108)..(108): Xaa can be any naturally occurring amino acid
  misc_feature (117)..(117): Xaa can be any naturally occurring amino acid
  misc_feature (140)..(140): Xaa can be any naturally occurring amino acid
  misc_feature (148)..(148): Xaa can be any naturally occurring amino acid
  misc_feature (239)..(239): Xaa can be any naturally occurring amino acid
  misc_feature (263)..(263): Xaa can be any naturally occurring amino acid
  misc_feature (278)..(278): Xaa can be any naturally occurring amino acid
  misc_feature (281)..(281): Xaa can be any naturally occurring amino acid
  misc_feature (289)..(289): Xaa can be any naturally occurring amino acid
  misc_feature (293)..(293): Xaa can be any naturally occurring amino acid
  misc_feature (297)..(297): Xaa can be any naturally occurring amino acid
  misc_feature (356)..(356): Xaa can be any naturally occurring amino acid
  misc_feature (395)..(395): Xaa can be any naturally occurring amino acid
NTVEPLTGITERVGRIWGVVSHLNCVADTPELRAVYNELMPEITVFFTEIGQDIELYNRFKTIKNSPEFDTLSPAQKTKLNHYASEKLREAKYAFSETXVKKYFPVGXVLNGLFAQXKKLYGIGFTEKTVPVWHKDVRYXELQQNGEXIGGVYMDLYAREGKRGGAWMNDYKGRRRFSDGTLQLPTAYLVCNFAPPVGGREARLSHDEILILFHETGHGLHHLLTQVDELGVSGINGVXWDAVELPSQFMENFVWEYNVLAQXSAHEETGVPLPKELXDKXLAAKNFQXGMFXVRQXEFALFDMMIYSEDDEGRLKNWQQVLDSVRKKVAVIQPPEYNRFALSFGHIFAGGYSAAXYSYAWAEVLSADAYAAFEESDDVAATGKRFWQEILAVGXSRSGAESFKAFRGREPSIDALLRHSGFDNAV

SEQ ID NO: 3088 - DNA, 2037 bp, Neisseria gonorrhoeae; identical to SEQ ID NO: 481

SEQ ID NO: 3089 - protein, 678 aa, Neisseria gonorrhoeae; identical to SEQ ID NO: 482

SEQ ID NO: 3090 - DNA, 2037 bp, Neisseria meningitidis; identical to SEQ ID NO: 485

SEQ ID NO: 3091 - protein, 678 aa, Neisseria meningitidis; identical to SEQ ID NO: 486

SEQ ID NO: 3092 - DNA, 2037 bp, Neisseria meningitidis; identical to SEQ ID NO: 489

SEQ ID NO: 3093 - protein, 678 aa, Neisseria meningitidis; identical to SEQ ID NO: 490

SEQ ID NO: 3094 - DNA, 1473 bp, Neisseria gonorrhoeae; identical to SEQ ID NO: 487

SEQ ID NO: 3095 - protein, 491 aa, Neisseria gonorrhoeae; identical to SEQ ID NO: 488

SEQ ID NO: 3096 - DNA, 2037 bp, Neisseria meningitidis; identical to SEQ ID NO: 485

SEQ ID NO: 3097 - protein, 678 aa, Neisseria meningitidis; identical to SEQ ID NO: 486

SEQ ID NO: 3098 - DNA, 534 bp, Neisseria meningitidis; identical to SEQ ID NO: 717

SEQ ID NO: 3099 - protein, 177 aa, Neisseria meningitidis; identical to SEQ ID NO: 718
  misc_feature (116)..(116): Xaa can be any naturally occurring amino acid

SEQ ID NO: 3100 - DNA, 534 bp, Neisseria gonorrhoeae; identical to SEQ ID NO: 715

SEQ ID NO: 3101 - protein, 177 aa, Neisseria gonorrhoeae; identical to SEQ ID NO: 716

SEQ ID NO: 3102 - DNA, 534 bp, Neisseria meningitidis; identical to SEQ ID NO: 719

SEQ ID NO: 3103 - protein, 177 aa, Neisseria meningitidis; identical to SEQ ID NO: 720

SEQ ID NO: 3104 - DNA, 1467 bp, Neisseria meningitidis; identical to SEQ ID NO: 1201

SEQ ID NO: 3105 - protein, 488 aa, Neisseria meningitidis; identical to SEQ ID NO: 1202

SEQ ID NO: 3106 - DNA, 1290 bp, Neisseria gonorrhoeae; identical to SEQ ID NO: 1199

SEQ ID NO: 3107 - protein, 429 aa, Neisseria gonorrhoeae; identical to SEQ ID NO: 1200

SEQ ID NO: 3108 - DNA, 1494 bp, Neisseria meningitidis; identical to SEQ ID NO: 1203

SEQ ID NO: 3109 - protein, 497 aa, Neisseria meningitidis; identical to SEQ ID NO: 1204

SEQ ID NO: 3110 - DNA, 963 bp, Neisseria meningitidis; identical to SEQ ID NO: 1327

SEQ ID NO: 3111 - protein, 320 aa, Neisseria meningitidis; identical to SEQ ID NO: 1328

SEQ ID NO: 3112 - DNA, 963 bp, Neisseria gonorrhoeae; identical to SEQ ID NO: 1325

SEQ ID NO: 3113 - protein, 320 aa, Neisseria gonorrhoeae; identical to SEQ ID NO: 1326

SEQ ID NO: 3114 - DNA, 963 bp, Neisseria meningitidis; identical to SEQ ID NO: 1329

SEQ ID NO: 3115 - protein, 320 aa, Neisseria meningitidis; identical to SEQ ID NO: 1330

SEQ ID NO: 3116 - protein, 222 aa, Neisseria meningitidis
MDSFFKPAVWAVLWLMFAVRPALADELTNLLSSREQILRQFAEDEQPVLPVNRAPARRAGNADELIGSAMGLNEQPVLPVNRAPARRAGNADELIGSAMGLLGIAYRYGGTSVSTGFDCSGFMQHIFKRAMGINLPRTSAEQARMGAPVARSELQPGDMVFFRTLGGSRISHVGLYIGNNRFIHAPRTGKNIEITSLSHKYWSGKYAFARRVKKNDPSRFLN

SEQ ID NO: 3117 - protein, 280 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRVPARRAGNADELIGNAMGLNEQPVLPVNRAPARRAGNADELIGNAMGLLGIAYRYGGTSISTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 3118 - protein, 251 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSISTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 3119 - protein, 251 aa, Neisseria meningitidis; identical to SEQ ID NO: 802

SEQ ID NO: 3120 - protein, 251 aa, Neisseria meningitidis
MDSFFKPAVWAVLWLMFAVRLALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 3121 - protein, 251 aa, Neisseria meningitidis; identical to SEQ ID NO: 802

SEQ ID NO: 3122 - protein, 251 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGSAMGLNEQPVLPVNRAPARRAGNADELIGNAMGLLGIAYRYGGTSISTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 3123 - protein, 251 aa, Neisseria meningitidis; identical to SEQ ID NO: 802

SEQ ID NO: 3124 - protein, 251 aa, Neisseria meningitidis; identical to SEQ ID NO: 802

SEQ ID NO: 3125 - protein, 251 aa, Neisseria meningitidis; identical to SEQ ID NO: 3122

SEQ ID NO: 3126 - protein, 251 aa, Neisseria meningitidis; identical to SEQ ID NO: 3118

SEQ ID NO: 3127 - protein, 251 aa, Neisseria meningitidis; identical to SEQ ID NO: 802

SEQ ID NO: 3128 - protein, 280 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLNEQPVLPVNRAPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 3129 - protein, 251 aa, Neisseria meningitidis; identical to SEQ ID NO: 3118

SEQ ID NO: 3130 - protein, 251 aa, Neisseria meningitidis
MDSFFKPAVWAVLWLMFAVRPALADELTNLLSSREQILRQFAEDEQPVLPVNRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFIQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 3131 - protein, 251 aa, Neisseria meningitidis; identical to SEQ ID NO: 802

SEQ ID NO: 3132 - protein, 222 aa, Neisseria meningitidis
MDSFFKPAVWAVLWLMFAVRPALADELTNLLSSREQILRQFAEDEQPVLPINRAPARRAGNADELIGSAMGLNEQPVLPVNRVPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 3133 - protein, 251 aa, Neisseria meningitidis; identical to SEQ ID NO: 802

SEQ ID NO: 3134 - protein, 251 aa, Neisseria meningitidis; identical to SEQ ID NO: 802

SEQ ID NO: 3135 - protein, 251 aa, Neisseria meningitidis; identical to SEQ ID NO: 802

SEQ ID NO: 3136 - protein, 251 aa, Neisseria meningitidis; identical to SEQ ID NO: 802

SEQ ID NO: 3137 - protein, 280 aa, Neisseria meningitidis
MDSFFKPAVWAVLWLMFAVRPALADELTNLLSSREQILRQFAEDEQPVLPINRAPARRAGNADELIGSAMGLNEQPVLPINRAPARRAGNADELIGSAMGLNEQPVLPVNRVPARRAGNADELIGNAMGLNEQPVLPVNRAPARRAGNADELIGNAMGLLGIAYRYGGTSVSTGFDCSGFMQHIFKRAMGINLPRTSAEQARMGTPVARSELQPGDMVFFRTLGGSRISHVGLYIGNNRFIHAPRTGKNIEITSLSHKYWSGKYAFARRVKKNDPSRFLN

SEQ ID NO: 3138 - protein, 251 aa, Neisseria meningitidis; identical to SEQ ID NO: 802

SEQ ID NO: 3139 - protein, 251 aa, Neisseria meningitidis; identical to SEQ ID NO: 3118

SEQ ID NO: 3140 - protein, 251 aa, Neisseria meningitidis; identical to SEQ ID NO: 3118

SEQ ID NO: 3141 - protein, 251 aa, Neisseria meningitidis; identical to SEQ ID NO: 3118

SEQ ID NO: 3142 - protein, 251 aa, Neisseria meningitidis; identical to SEQ ID NO: 3118

SEQ ID NO: 3143 - protein, 251 aa, Neisseria meningitidis; identical to SEQ ID NO: 3118

SEQ ID NO: 3144 - protein, 251 aa, Neisseria meningitidis; identical to SEQ ID NO: 802

SEQ ID NO: 3145 - protein, 251 aa, Neisseria meningitidis; identical to SEQ ID NO: 802

SEQ ID NO: 3146 - protein, 251 aa, Neisseria meningitidis; identical to SEQ ID NO: 802

SEQ ID NO: 3147 - protein, 222 aa, Neisseria meningitidis; identical to SEQ ID NO: 3116

SEQ ID NO: 3148 - protein, 222 aa, Neisseria meningitidis
MDSFFKPAVWAVLWLMFAVRSALADELTNLLSSREQILRQFAEDEQPVLPVNRAPARRAGNADELIGSAMGLNEQPVLPVNRAPARRAGNADELIGSAMGLLGIAYRYGGTSVSTGFDCSGFMQHIFKRAMGINLPRTSAEQARMGAPVARSELQPGDMVFFRTLGGSRISHVGLYIGNNRFIHAPRTGKNIEITSLSHKYWSGKYAFARRIKKNDPSRFLN

SEQ ID NO: 3149 - protein, 251 aa, Neisseria meningitidis; identical to SEQ ID NO: 3118

SEQ ID NO: 3150 - protein, 215 aa, Neisseria meningitidis; identical to SEQ ID NO: 870

SEQ ID NO: 3151 - protein, 215 aa, Neisseria meningitidis
MKPLILGLAAVLALSACQVQKAPDFDYTSFKESKPASILVVPPLNESPDVNGTWGVLASTAAPLSEAGYYVFPAAVVEETFKENGLTNAADIHAVRPEKLHQIFGNDAVLYITVTEYGTSYQILDSVTTVSAKARLVDSRNGKELWSGSASIREGSNNSNSGLLGALVSAVVNQIANNLTDRGYQVSKTAAYNLLSPYSHNGILKGPRFVEEQPK

SEQ ID NO: 3152 - protein, 215 aa, Neisseria meningitidis; identical to SEQ ID NO: 872

SEQ ID NO: 3153 - protein, 215 aa, Neisseria meningitidis; identical to SEQ ID NO: 872

SEQ ID NO: 3154 - protein, 215 aa, Neisseria meningitidis; identical to SEQ ID NO: 872

SEQ ID NO: 3155 - protein, 215 aa, Neisseria meningitidis; identical to SEQ ID NO: 3151

SEQ ID NO: 3156 - protein, 215 aa, Neisseria meningitidis; identical to SEQ ID NO: 872

SEQ ID NO: 3157 - protein, 215 aa, Neisseria meningitidis; identical to SEQ ID NO: 3151

SEQ ID NO: 3158 - protein, 215 aa, Neisseria meningitidis
MKPLILGLAAALVLSACQVQKAPDFDYTSFKESKPASILVVPPLNESPDVNGTWGMLASTAEPLSEAGYYVFPAAVVEETFKQNGLTNAADIHAVQPEKLHQIFGNDAVLYITITEYGTSYQILDSVTTVSARARLVDSRNGKVLWSGSASIREGSNNSNSGLLGALVSAVVNQIANSLTDRGYQVSKTAAYNLLSPYSHNGILKGPRFVEEQPK

SEQ ID NO: 3159 - protein, 215 aa, Neisseria meningitidis; identical to SEQ ID NO: 872

SEQ ID NO: 3160 - protein, 215 aa, Neisseria meningitidis; identical to SEQ ID NO: 872

SEQ ID NO: 3161 - protein, 215 aa, Neisseria meningitidis; identical to SEQ ID NO: 872

SEQ ID NO: 3162 - protein, 215 aa, Neisseria meningitidis
MKPLILGLAAVLALSACQVQKAPDFDYTSFKESKPASILVVPPLNESPDVNGTWGVLASTAAPLSEAGYYVFPAAVVEETFKQNGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSHNGILKGPRFVEEQPK

SEQ ID NO: 3163 - protein, 215 aa, Neisseria meningitidis; identical to SEQ ID NO: 872

SEQ ID NO: 3164 - protein, 215 aa, Neisseria meningitidis; identical to SEQ ID NO: 872

SEQ ID NO: 3165 - protein, 215 aa, Neisseria meningitidis; identical to SEQ ID NO: 872

SEQ ID NO: 3166 - protein, 215 aa, Neisseria meningitidis; identical to SEQ ID NO: 3162

SEQ ID NO: 3167 - protein, 215 aa, Neisseria meningitidis; identical to SEQ ID NO: 872

SEQ ID NO: 3168 - protein, 215 aa, Neisseria meningitidis; identical to SEQ ID NO: 872

SEQ ID NO: 3169 - protein, 215 aa, Neisseria meningitidis; identical to SEQ ID NO: 872

SEQ ID NO: 3170 - protein, 215 aa, Neisseria meningitidis; identical to SEQ ID NO: 872

SEQ ID NO: 3171 - protein, 215 aa, Neisseria meningitidis; identical to SEQ ID NO: 872

SEQ ID NO: 3172 - protein, 215 aa, Neisseria meningitidis
MKPLILGLAAVLALSACQVQKAPDFDYTSFKESKPASILVVPPLNESPDVNGTWGMLASTAAPLSEAGYYVFPAAVVEETFKQNGLTNAADIHAVRPEKLHQIFGNDAVLYITVTEYGTSYQILDSVTTVSAKARLVDSRNGKELWSGSASIREGSNNSNSGLLGALVGAVVNQIANSLTDRGYQVSKTAAYNLLSPYSHNGILKGPRFVEEQPK

SEQ ID NO: 3173 - protein, 215 aa, Neisseria meningitidis; identical to SEQ ID NO: 872

SEQ ID NO: 3174 - protein, 215 aa, Neisseria meningitidis; identical to SEQ ID NO: 872

SEQ ID NO: 3175 - protein, 215 aa, Neisseria meningitidis; identical to SEQ ID NO: 872

SEQ ID NO: 3176 - protein, 215 aa, Neisseria meningitidis
MKPLILGLAAVLALSACQVQKAPDFDYTAFKESKPASILVVPPLNESPDVNGTWGMLASTAEPLSEAGYYVFPAAVVEETFKQNGLTNAADIHAVRPEKLHQIFGNDAVLYITITEYGTSYQILDSVTTVSARARLVDSRNGKVLWSGSASIREGSNNSNSGLLGALVGAVVNQIANSLTDRGYQVSKAAAYDLLSPYSHNGILKGPRFVEEQPK

SEQ ID NO: 3177 - protein, 215 aa, Neisseria meningitidis; identical to SEQ ID NO: 870

SEQ ID NO: 3178 - protein, 215 aa, Neisseria meningitidis; identical to SEQ ID NO: 870

SEQ ID NO: 3179 - protein, 215 aa, Neisseria meningitidis; identical to SEQ ID NO: 872

SEQ ID NO: 3180 - protein, 492 aa, Neisseria meningitidis
MFKRSVIAMACIFALSACGGGGGGSPDVKSADTLSKPAAPVVSEKETEAKEDAPQAGSQGQGAPSAQGGQDMAAVSEENTGNGGAAATDKPKNEDEGAQNDMPQNAADTDSLTPNHTPASNMPAGNMENQAPDAGESEQPANQPDMANTADGMQGDDPSAGGENAGNTAAQGTNQAENNQTAGSQNPASSTNPSATNSGGDFGRTNVGNSVVIDGPSQNITLTHCKGDSCSGNNFLDEEVQLKSEFEKLSDADKISNYKKDGKNDGKNDKFVGLVADSVQMKGINQYIIFYKPKPTSFARFRRSARSRRSLPAEMPLIPVNQADTLIVDGEAVSLTGHSGNIFAPEGNYRYLTYGAEKLPGGSYALRVQGEPSKGEMLAGTAVYNGEVLHFHTENGRPSPSRGRFAAKVDFGSKSVDGIIDSGDGLHMGTQKFKAAIDGNGFKGTWTENGGGDVSGKFYGPAGEEVAGKYSYRPTDAEKGGFGVFAGKKEQD

SEQ ID NO: 3181 - protein, 492 aa, Neisseria meningitidis; identical to SEQ ID NO: 3180

SEQ ID NO: 3182 - protein, 488 aa, Neisseria meningitidis; identical to SEQ ID NO: 1202

SEQ ID NO: 3183 - protein, 497 aa, Neisseria meningitidis; identical to SEQ ID NO: 1204

SEQ ID NO: 3184 - protein, 429 aa, Neisseria meningitidis; identical to SEQ ID NO: 1200

SEQ ID NO: 3185 - protein, 488 aa, Neisseria meningitidis; identical to SEQ ID NO: 1202

SEQ ID NO: 3186 - protein, 315 aa, Neisseria meningitidis; identical to SEQ ID NO: 1454

SEQ ID NO: 3187 - protein, 315 aa, Neisseria meningitidis; identical to SEQ ID NO: 1452

SEQ ID NO: 3188 - protein, 315 aa, Neisseria meningitidis; identical to SEQ ID NO: 1456

SEQ ID NO: 3189 - protein, 315 aa, Neisseria meningitidis
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 3190 - protein, 315 aa, Neisseria meningitidis; identical to SEQ ID NO: 3189

SEQ ID NO: 3191 - protein, 315 aa, Neisseria meningitidis; identical to SEQ ID NO: 3189

SEQ ID NO: 3192 - protein, 315 aa, Neisseria meningitidis; identical to SEQ ID NO: 3189

SEQ ID NO: 3193 - protein, 315 aa, Neisseria meningitidis
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVFSALDEAAGAWGVKVLRYEIKDLVPPQEILRSMQAQITAERKKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 3194 - protein, 315 aa, Neisseria meningitidis; identical to SEQ ID NO: 1456

SEQ ID NO: 3195 - protein, 315 aa, Neisseria meningitidis
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 3196 - protein, 315 aa, Neisseria meningitidis; identical to SEQ ID NO: 1456

SEQ ID NO: 3197 - protein, 315 aa, Neisseria meningitidis; identical to SEQ ID NO: 1456

SEQ ID NO: 3198 - protein, 315 aa, Neisseria meningitidis; identical to SEQ ID NO: 1456

SEQ ID NO: 3199 - protein, 315 aa, Neisseria meningitidis
MEFFIILLVAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSMISAGMKIIDSSKTAK

SEQ ID NO: 3200 - protein, 315 aa, Neisseria meningitidis; identical to SEQ ID NO: 1456

SEQ ID NO: 3201 - protein, 315 aa, Neisseria meningitidis
MEFFIILLAAVVVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVSALDEAAGAWGVKVLRYEIKDLVPPQEILRSMQAQITAEREKRARIAESEGRKIEQINLASGQREAKIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 3202 - protein, 315 aa, Neisseria meningitidis
MEFFIILLAAVVVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSTVVAALDEAAGAWGVKVLRYEIKDLVPPQEILRSMQAQITAEREKRARIAESEGRKIEQINLASGQREAEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSSKTAK

SEQ ID NO: 3203 - protein, 315 aa, Neisseria meningitidis; identical to SEQ ID NO: 1456

SEQ ID NO: 3204 - protein, 315 aa, Neisseria meningitidis; identical to SEQ ID NO: 3195

SEQ ID NO: 3205 - protein, 315 aa, Neisseria meningitidis
MEFFIILLAAVAVFGFKSFVVIPQQEVHVVERLGRFHRALTAGLNILIPFIDRVAYRHSLKEIPLDVPSQVCITRDNTQLTVDGIIYFQVTDPKLASYGSSNYIMAITQLAQTTLRSVIGRMELDKTFEERDEINSIVVSALDEAAGAWGVKVLRYEIKDLVPPQEILRSMQAQITAEREKRARIAESEGRKIEQINLASGQREPEIQQSEGEAQAAVNASNAEKIARINRAKGEAESLRLVAEANAEAIRQIAAALQTQGGADAVNLKIAEQYVAAFNNLAKESNTLIMPANVADIGSLISAGMKIIDSNKTAK

SEQ ID NO: 3206 - protein, 315 aa, Neisseria meningitidis; identical to SEQ ID NO: 1454

SEQ ID NO: 3207 - protein, 315 aa, Neisseria meningitidis; identical to SEQ ID NO: 3195

SEQ ID NO: 3208 - protein, 441 aa, Neisseria meningitidis; identical to SEQ ID NO: 2790

SEQ ID NO: 3209 - protein, 441 aa, Neisseria meningitidis; identical to SEQ ID NO: 2794

SEQ ID NO: 3210 - protein, 441 aa, Neisseria meningitidis; identical to SEQ ID NO: 2792

SEQ ID NO: 3211 - protein, 441 aa, Neisseria meningitidis; identical to SEQ ID NO: 2792

SEQ ID NO: 3212 - protein, 441 aa, Neisseria meningitidis; identical to SEQ ID NO: 2792

SEQ ID NO: 3213 - protein, 441 aa, Neisseria meningitidis
MKKYLFRAALCGIAAAILAACQSKSIQTFPQPDTSVINGPDRPVGIPAPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3214 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLSCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3215 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3216 - protein, 441 aa, Neisseria meningitidis; identical to SEQ ID NO: 2792

SEQ ID NO: 3217 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3218 - protein, 441 aa, Neisseria meningitidis
MKKYLFRAALCGIAAAILAACQSKSIQTFPQPDTSVINGPDRPVGIPAPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSGNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3219 - protein, 441 aa, Neisseria meningitidis; identical to SEQ ID NO: 3218

SEQ ID NO: 3220 - protein, 441 aa, Neisseria meningitidis
MKKYLFRAALCGIAAAILAACQSKSIQTFPQPDTSVINGPDRPVGIPAPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3221 - protein, 441 aa, Neisseria meningitidis; identical to SEQ ID NO: 2792

SEQ ID NO: 3222 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAEQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3223 - protein, 441 aa, Neisseria meningitidis
MKKYLFRAALCGIAAAILAACQSKSIQTFPQPDTSVINGPDRPVGIPAPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSRNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3224 - protein, 441 aa, Neisseria meningitidis
MKKYLFRAALYGIAAAILAACQSKSIQTFPQPDTSVINGPDRPVGIPDLAGTTVGGGGAVYTVVPHLSLPHWAAQDFAKSLQSFRLGCANLKNHQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSGNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3225 - protein, 441 aa, Neisseria meningitidis
MKKYLFRAALCGIAAAILAACQSKSIQTFPQPDTSVINGPGRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3226 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3227 - protein, 441 aa, Neisseria meningitidis; identical to SEQ ID NO: 2792

SEQ ID NO: 3228 - protein, 441 aa, Neisseria meningitidis; identical to SEQ ID NO: 2792

SEQ ID NO: 3229 - protein, 441 aa, Neisseria meningitidis; identical to SEQ ID NO: 2792

SEQ ID NO: 3230 - protein, 441 aa, Neisseria meningitidis; identical to SEQ ID NO: 2792

SEQ ID NO: 3231 - protein, 441 aa, Neisseria meningitidis; identical to SEQ ID NO: 2794

SEQ ID NO: 3232 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGKYMADKGYLKLGQTSMQGIKSYMRQNPQRLAEVLGQNPSYIFFRELAGSSNDGPVGALGTPLMGEYAGAVDRHYITLGAPLFVATAHPVTSKALNRLIMAQDTGSAIKGAVRVDYFWGYGDEAGETAGKMKEPGYVWQLLPNGMKPEYRP

SEQ ID NO: 3233 - protein, 441 aa, Neisseria meningitidis; identical to SEQ ID NO: 3218

SEQ ID NO: 3234 - protein, 441 aa, Neisseria meningitidis; identical to SEQ ID NO: 3218

SEQ ID NO: 3235 - protein, 441 aa, Neisseria meningitidis
MKKYLFRAALYGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSVQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMQQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3236 - protein, 441 aa, Neisseria meningitidis
MKKYLFRAALYGISAAILAACQSKSIQTFPQPDTSVINGPDRPAGIPDPAGTTVAGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELTGSSNDGPVGALGTPLMGEYAGAVDRHYITLGAPLFVATAHPVTRKALNRLIMAQDTGSAIKGAVRVDYFWGYGDEAGETAGKMKEPGYVWQLLPNGMKPEYRP

SEQ ID NO: 3237 - protein, 441 aa, Neisseria meningitidis
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSSNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3238 - protein, 441 aa, Neisseria meningitidis
MKKYLFRAALCGIAAAILAACQSKSIQTFPQPDTSVINGPDRPVGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNTGGTHTADLSQFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPQRLAEVLGQNPSYIFFRELTGSGNDGPVGALGTPLMGEYAGAVDRHYITLGAPLFVATTHPITRKALNRLIMAQDTGSAIKGAVRVDYFWGYGDEAGELAGKQKTTGYVWQLLPNGMKPEYRP

SEQ ID NO: 3239 - protein, 441 aa, Neisseria meningitidis
MKKHLFRAALYGIAAAILAACQSKSIQTFPQPDTSIIKGPDRPAGIPDPAGTTVGGGGAVYTVVPHLSLPHWAAQDFAKSLQSFRLGCANLKNRQGWQDVCAQAFQTPVHSFQAKQFFERYFTPWQVAGNGSLAGTVTGYYEPVLKGDDRRTAQARFPIYGIPDDFISVPLPAGLRSGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYVFFRELAGSGNDGPVGALGTPLMGEYAGAVDRHYITLGAPLFVATAHPVTRKALNRLIMAQDTGSAIKGAVRVDYFWGYGDEAGELAGKQKTTGYVWQLLPNGMKPEYRP

SEQ ID NO: 3240 - protein, 441 aa, Neisseria meningitidis
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPVHSFQAKRFFERYFTPWQVAGNGSLAGTVTGYYEPVLKGDGRRTERARFPIYGIPDDFISVPLPAGLRGGKALVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKAYMRQNPQRLAEVLGQNPSYIFFRELAGSGGDGPVGALGTPLMGGYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 3241 - protein, 441 aa, Neisseria meningitidis
MKKHLLRSALYGIAAAILAACQSRSIQTFPQPDTSVINGPDRPAGIPDPAGTTVAGGGAVYTVVPHLSMPHWAAQDFAKSLQSFRLGCANLKNRQGWQDVCAQAFQTPIHSFQAKRFFERYFTPWQVAGNGSLAGTVTGYYEPVLKGDGRRTERARFPIYGIPDDFISVPLPAGLRGGKNLVRIRQTGKNSGTIDNAGGTHTADLSRFPITARTTAIKGRFEGSRFLPYHTRNQINGGALDGKAPILGYAEDPVELFFMHIQGSGRLKTPSGKYIRIGYADKNEHPYVSIGRYMADKGYLKLGQTSMQGIKSYMRQNPHKLAEVLGQNPSYIFFRELAGSGNEGPVGALGTPLMGEYAGAIDRHYITLGAPLFVATAHPVTRKALNRLIMAQDTGSAIKGAVRVDYFWGYGDEAGELAGKQKTTGYVWQLLPNGMKPEYRP

SEQ ID NO: 3242 - protein, 441 aa, Neisseria meningitidis; identical to SEQ ID NO: 3217

SEQ ID NO: 3243 - protein, 215 aa, Neisseria meningitidis; identical to SEQ ID NO: 872

SEQ ID NO: 3244 - DNA, 582 bp, Neisseria meningitidis
atgaaacacactgtatccgcatcggtcatcctgcttttgaccgcttgcgcgcaattacctcaaaataacgaaaacctgtggcagccgtccgaacacacccgcagtttcacggcggaagggcggttggcagtgaaagcggaagggaaaggttcgtatgcaaatttcgattggacataccaaccgcccgtggaaaccatcaatatcaacacccctttgggcagtacgctcgggcagttgtgtcaagacagggacggcgcattggcagtggacggcaaaggaaatgtctatcaggcggaaagtgcggaagaattgagcaggcagctggtcggtttcaaactgccaatccaatatctgcatatctgggcagatggcaggcctgtggcgggcgcgccttaccgcatcctgccggacggcatattggaacaatacggttggactgtcggcagaaccgccgacagtggggggcaagtccgaacgttgcaactgaataacggaaatttgaacatcaggctggttttcaccgagattggtatgccgtctgaaaccgaaacccaagaacaatgcgcggcacgcatacagtaa

SEQ ID NO: 3245 - protein, 351 aa, Neisseria meningitidis
VPPVQSAPVYTPPAYVPPSAPAVSGTYVPSYAPVDINAATHTIVRGDTVYNISKRYHISQDDFRAWNGMTDNTLSIGQIVKVKPAGYAAPKAAAVKSRPAVPAAAQPPVQSAPVDINAATHTIVRGDTVYNISKRYHISQDDFRAWNGMTDNMLSIGQIVKVKPAGYAAPKTAAVESRPAVPAAVQTPVKPAAQPPVQSAPQPAAPAAENKAVPAPAPQSPAASPSGTRSVGGIVWQRPTQGKVVADFGGNNKGVDIAGNAGQPVLAAADGKVVYAGSGLRGYGNLVIIQHNSSFLTAYGHNQKLLVGEGQQVKRGQQVALMGNTDASRTQLHFEVRQNGKPVNPNSYIAF

SEQ ID NO: 3246 - DNA, 1248 bp, Neisseria meningitidis
  misc_feature (224)..(224): n is a, c, g, or t
  misc_feature (289)..(289): n is a, c, g, or t
atgttgacaccaacaacactttaggtagcttgtaccgcccttgccgctcagttgggcggatgccccacccaacacccttctcctgtcattgcaggcaattcaggtatgcagaccgtaccgtctgcgccggtttacaatccttatggcgcaacgccgtacaatgccgctcctgccgccaacgatgcgccgtatgtgccgccggtgcaaagcgcgccggtttatangcctcctgcttatgttccgccgtctgcacctgccgtttcgggtacatacgttccttcttacgcanccgtcgacatcaacgcggcgacccatactattgtgcgcggcgacaccgtgtacaagatttccaaatgctaccatatctctcaagacgatttccgtgcgtggaacggcatgaccgacaatacgttgagcatcggtcagattgttaaagtcaaaccggcaggatatgccgcaccgaaagccgcagccgtaaaaagcaggcccgccgtaccggctgccgcgcaaccgctcgtacagtccgcacccgtcgacatcaacgcggcgacgcatactattgtgcgcggcgacacggtgtacaacatttccaaacgctaccatatctctcaagacgatttccgtgcgtggaacggcatgaccgacaatacgttgagcatcggtcagattgttaaagtcaaaccggcaggatatgccgcaccgaaagccgcagccgtaaaaagcaggcccgccgtaccggctgccgtgcaaacccctgtgaaacccgccgcgcaaccgcctgtgcagtccgcgccgcaacctgccgcgcccgctgcggaaaataaagcggttcccgcgcccgccccgcaatctcctgccgcttcgccttccggcacgcgttcggtcggcggcattgtttggcagcgtccgacgcaaggtaaagtggttgccgatttcggcggcaacaacaagggtgtcgatattgcaggaaatgcgggacagcccgttttggcggcggctgacggcaaagtggtttatgcaggttccggtttgaggggatacggcaatttggtcatcatccagcataattcttccttcctgaccgcatacgggcacaaccaaaaattgctggtcggcgaaggccagcaggtcaaacgcgggcagcaggtcgctttgatgggcaataccgaggcttctagaacgcagcttcatttcgaggtgcggcaaaacggcaaaccggttaatccgaacagctatatcgcgttctga

SEQ ID NO: 3247 - protein, 414 aa, Neisseria meningitidis
  misc_feature (74)..(74): Xaa can be any naturally occurring amino acid
  misc_feature (96)..(96): Xaa can be any naturally occurring amino acid
MLTPTTLVACTALAAQLGGCPTQHPSPVIAGNSGMQTVPSAPVYNPYGATPYNAAPAANDAPYVPPVQSAPVYXPPAYVPPSAPAVSGTYVPSYAXVDINAATHTIVRGDTVYKISKCYHISQDDFRAWNGMTDNTLSIGQIVKVKPAGYAAPKAAAVKSRPAVPAAAQPLVQSAPVDINAATHTIVRGDTVYNISKRYHISQDDFRAWNGMTDNTLSIGQIVKVKPAGYAAPKAAAVKSRPAVPAAVQTPVKPAAQPPVQSAPQPAAPAAENKAVPAPAPQSPAASPSGTRSVGGIVWQRPTQGKVVADFGGNNKGVDIAGNAGQPVLAAADGKVVYAGSGLRGYGNLVIIQHNSSFLTAYGHNQKLLVGEGQQVKRGQQVALMGNTEASRTQLHFEVRQNGKPVNPNSYIAF

SEQ ID NO: 3248 - DNA, 849 bp, Neisseria gonorrhoeae
  misc_feature (741)..(741): n is a, c, g, or t
atggtgtccctccgcttcagattcggcaaccactttaaacgccgacattctgacaatttccttttccgccagccaaatatcatgcgtatctttcggttcgggcttgttgggcatggcaaccttcaacagccgcgccatcacaggaatcgtcgttccctgaatcagcagcgacagcaccaccacggcaaacgccacatcaaacagcaggtgcgaattgggaacgcccatcaccagcggcatcatcgccagcgaaatcggtacggctcctcgcaagcccaaccaactgatatacgccttttcacgcaggctgtaattgaatttccacaaaccgccgaacactgccagcggacgcgcgaccagcatcaggaacgccgcaatcgccaaggcttccgccgccctgtccaacacgccggcgggagaaaccagcagaccgagcatgacgaacaaagttgcctgcgccagccaagccaaaccgtccatcacacgcaaaacgtgttccgtcgcacggttgcgctggttaccgacaatgatgccggcaaggtaaaccgccaaaaagccgctgccgcctatggtattggtaaacgcaaacacaagcagcccgcccgacacaatcatcagcgcgtacagaccttccgtacacacctccaattcccaatcaacgtcatagctgtctcccgtgttaaaatgttcttcacttcagaatcccccccttcttcccagcccgaaaccttcatgtgttanaccctggggtgccccaacggatttagtaacctcccaatgactctgcttgtcgcccccttcgcccgctttctccttccgggaaaacttgttgtccccgtcttacattaa

SEQ ID NO: 3249 - protein, 282 aa, Neisseria gonorrhoeae
  misc_feature (247)..(247): Xaa can be any naturally occurring amino acid
MVSLRFRFGNHFKRRHSDNFLFRQPNIMRIFRFGLVGHGNLQQPRHHRNRRSLNQQRQHHHGKRHIKQQVRIGNAHHQRHHRQRNRYGSSQAQPTDIRLFTQAVIEFPQTAEHCQRTRDQHQERRNRQGFRRPVQHAGGRNQQTEHDEQSCLRQPSQTVHHTQNVFRRTVALVTDNDAGKVNRQKAAAAYGIGKRKHKQPARHNHQRVQTFRTHLQFPINVIAVSRVKMFFTSESPPSSQPETFMCXTLGCPNGFSNLPMTLLVAPFARFLLPGKLVVPVLH

SEQ ID NO: 3250 - DNA, 252 bp, Neisseria meningitidis
cgcctgaagcacggtgtcggactgcatttctattcggctatacgccttttcacgcaggctgtaattgaatttccacaaaccgccgaacactgccgacggacgcgcgaccagcatcaggaacgccgcaatcgccaaggcttccgccgccctgtccaacacgttggcaggagaaaccagcagcaaaggcattcccaaacgtgcggacaaagtggtcgaaaccacgctcagaaacaacagtgcgccacccggcag

SEQ ID NO: 3251 - protein, 84 aa, Neisseria meningitidis
RLKHGVGLHFYSAIRLFTQAVIEFPQTAEHCRRTRDQHQERRNRQGFRRPVQHVGRRNQQQRHSQTCGQSGRNHAQKQQCATRQ

SEQ ID NO: 3252 - DNA, 213 bp, Neisseria meningitidis
atacgccttttcacgcaggctgtaattgaatttccacaaaccgccgaacactgccggcggacgcgcgaccagcatcaggaacgccgcaatcgccaaggcttccgccgccccgtccaacacgttggcaggagaaaccagcagcaaaggcattcccaaacgtgcggacaaagtggtcgaaaccacgctcagaaacaacagtgcgccacccggcag

SEQ ID NO: 3253 - protein, 71 aa, Neisseria meningitidis
IRLFTQAVIEFPQTAEHCRRTRDQHQERRNRQGFRRPVQHVGRRNQQQRHSQTCGQSGRNHAQKQQCATRQ

SEQ ID NO: 3254 - DNA, 771 bp, Neisseria gonorrhoeae
atgcggcgaaacgtgcctgccgtcgccgtattgcgccgcccacgattcgaggcgtttttggatttggcgttggctcaggcgcgtgccgttcctgccggtaaacagggctttgccgtccgatgccgtctgacgcagcggcagatagtttttcaaggcttccacgcttttgccggtcagcggaacctgacgctgcttgcgccctttgccggtaacgtgtacccacgcttcgtccaaatatacatcatctgcattcaagccgtgtatctcgctcacgcgcaaaccgctgccgtacatcagctcgaacagcgcgtggtcgcgcaccgccagcgggtcgccgccgtccacgggcaaatccaacatccggttcagccattcctgcggcagggctttgggtacgcgctcgggctgcttcggcggtttgatgtcggcggtcgggtcggcgcgcatcagcccgcgtttgaccagccaggcgcaatactgccgccacgccgacagcttgcgcgccagcgtccgaccgtccaaaccgcgctgcgacagccgccgcaacgccgccgtaaaatcgcgccgcgacaagtcctgcggcacgccgcctgcatcttcagacggcatttgtgccaacagtgcaaacagttcttccaaatcgcgccggtatgccgcaaccgtgtgctccgacttgccctcgcgcacgatgttttccaaataagcgtcaaaatacgccgcaaacccgtccaaaaccataaccgtcccacacaaatatcaaaaaaccagtga

SEQ ID NO: 3255 - protein, 256 aa, Neisseria gonorrhoeae
MRRNVPAVAVLRRPRFEAFLDLALAQARAVPAGKQGFAVRCRLTQRQIVFQGFHAFAGQRNLTLLAPFAGNVYPRFVQIYIICIQAVYLAHAQTAAVHQLEQRVVAHRQRVAAVHGQIQHPVQPFLRQGFGYALGLLRRFDVGGRVGAHQPAFDQPGAILPPRRQLARQRPTVQTALRQPPQRRRKIAPRQVLRHAACIFRRHLCQQCKQFFQIAPVCRNRVLRLALAHDVFQISVKIRRKPVQNHNRPTQISKNQ

SEQ ID NO: 3256 - DNA, 527 bp, Neisseria meningitidis
atgcggcgaaacgtgcmtgcmgtcgccgttktgcgccgcccattgcgccaaacgtttttggatttggcgttggctcaggcgcgtgccgttcctgccggtaaacagggctttgccgtccgatgccgtctgacgcagcggcagatagtttttcagggcttccacgcttttgccgaccagcggcacctgccgctgttgcgccctttgccgataacgtgtacccacgcytcgtccaaatagacatcatctgcattcaagccgtgtatctcgctcacgcgcaaaccgctgccgtacatcagttcgaacagggcgtggtcgcgcaccgccagcgggtcgccgccgtccacgggcaaatccagcatccggttcagccattcctgcggcagggctttgggtacgcgctcgggctgcttcggcggtttgatgtcggcggtcgggtcggcgtgcatcaggccgcgctttaccagccaaacgcaatactgccgccaagacgaaagcttgcgagccagcgtccgttcccccaaaccgcg

SEQ ID NO: 3257 - protein, 176 aa, Neisseria meningitidis
  misc_feature (6)..(6): Xaa can be any naturally occurring amino acid
  misc_feature (11)..(11): Xaa can be any naturally occurring amino acid
  misc_feature (65)..(65): Xaa can be any naturally occurring amino acid
  misc_feature (76)..(76): Xaa can be any naturally occurring amino acid
MRRNVXAVAVXRRPLRQTFLDLALAQARAVPAGKQGFAVRCRLTQRQIVFQGFHAFADQRHLPLXAPFADNVYPRXVQIDIICIQAVYLAHAQTAAVHQFEQGVVAHRQRVAAVHGQIQHPVQPFLRQGFGYALGLLRRFDVGGRVGVHQAALYQPNAILPPRRKLASQRPFPQTA

SEQ ID NO: 3258 - DNA, 771 bp, Neisseria meningitidis
atgcggcgaaacgtgcctgccgtcgccgttttgcgccgcccattgcgccaaacgtttttggatttggcgttggctcaggcgcgtgccgttcctgccggtaaacagggctttgccgtccgatgccgtctgacgcagcggcagatagtttttcagggcttccacgcttttgccggtcagcggaacctgccgctgcttgcgtcctttgccggtaacgtgtacccacgcctcgtccaaatatacatcatctgcattcaagccgtgtatctcgctcacgcgcaaaccgctgccgtacatcagttcgaacagcgcgtgatcgcgcaccgccagcgggtcgccgccgtccacgggcaaatccagcatccggttcagccattcctgcggcagggctttgggtacgcgctcgggctgcttcggcggtttgatgtcggcggtcgggtcggtatgcagcagaccgcgtttgaccagccaggcgcaatactgccgccaagacgacagcttgcgcgccagcgtccgcgcattcaaaccgcgctgcgacagccgccgcaacgccgccgtaaaatcgcgctgcgacaagccctgcggcacgccgcctgcatcttcagacggcatttgtgccaacagcgcaaacagttcttccaaatcgcgccggtatgccgccaccgtgtgctccgacttgccctcgcgcacgatgttttccaaataagcgtcaaaatgcgccgcaaacccgtccaaaaccataaccgccccacacaaatatcaaaaaaacagtga

SEQ ID NO: 3259 - protein, 256 aa, Neisseria meningitidis
MRRNVPAVAVLRRPLRQTFLDLALAQARAVPAGKQGFAVRCRLTQRQIVFQGFHAFAGQRNLPLLASFAGNVYPRLVQIYIICIQAVYLAHAQTAAVHQFEQRVIAHRQRVAAVHGQIQHPVQPFLRQGFGYALGLLRRFDVGGRVGMQQTAFDQPGAILPPRRQLARQRPRIQTALRQPPQRRRKIALRQALRHAACIFRRHLCQQRKQFFQIAPVCRHRVLRLALAHDVFQISVKMRRKPVQNHNRPTQISKKQ

SEQ ID NO: 3260 - DNA, 1530 bp, Neisseria gonorrhoeae
atggcggcggcggacaaactcttgggcggcgaccgccgcagcgtcgccatcatcggagacggcgcgatgacggcggggcaggcgtttgaagccttgaattgcgcgggcgatatggatgtggatttgctggtcgtcctcaacgacaacgaaatgtcgatttcccccaacgtcggcgcgttgcccaaatatcttgccagcaacgtcgtgcgcgatatgcacggactgttgagtaccgtcaaagcgcaaacgggcaaggtattagacaaaatacccggcgcgatggagtttgcccaaaaagtcgaacacaaaatcaaaacccttgccgaagaagccgaacacgccaaacagtcgctgtcgctgtttgaaaatttcggcttccgctacaccggccccgtggacggacacaacgtcgagaatctggtggacgtattgaaagacttgcgcagccgcaaaggccctcagttgctgcacgtcatcaccaaaaagggcaacggctacaaactcgccgaaaacgaccccgtcaaataccacgccgtcgccaacctgcctaaagaaggcggggcgcaaatgccgtctgaaaaagaacccaagcccgccgccaaaccgacctatacccaagtattcggcaaatggctgtgcgaccgggcggcggcagattcccgactggttgcgattacccccgccatgcgcgagggcagcggactggtggagtttgaacaacgattccccgaccgctatttcgatgtcggcatcgccgagcagcacgccgttacctttgccggcggtttggcgtgcgaaggcatgaagcccgtcgtggcgatttattccacctttttacaacgcgcctacgaccaactggtgcacgacatcgccctgcaaaacctgcccgttttgtttgccgtcgaccgtgcgggcatcgtcggcgcggacggtccgacccatgccggcttgtacgatttgagcttcttgcgctgtgtgccgaacatgattgttgccgcgccgagcgatgaaaacgaatgccgcctgctgctttcgacctgctatcaggcggatgcgcccgccgccgtccgctatccgcgcggcacgggtacgggcgcgccggtttcagacggcatggaaaccgtggaaatcggcaagggcattatccgccgcgaaggtgagaaaaccgccttcattgccttcggcagtatggtcgccaccgcattggcggttgccgaaaaactgaacgccaccgtcgccgatatgcgcttcgtcaaaccgatagacgaagagttgattgtccgccttgcccgaagccacgaccgcatcgttacccttgaagaaaacgccgaacagggcggcgcaggcggcgcggtcttggaagtgttggcgaaacacggcatctgcaaacccgttttgcttttgggcgttgccgataccgtaaccgaacacggcgatccgaaaaaacttttggacgatttgggtttgagtgccgaagcggtggaacgccgggtgcgcgagtggctgccggaccgtgatgcggcaaattaa

SEQ ID NO: 3261 - protein, 509 aa, Neisseria gonorrhoeae
MAAADKLLGGDRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLKDLRSRKGPQLLHVITKKGNGYKLAENDPVKYHAVANLPKEGGAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCVPNMIVAAPSDENECRLLLSTCYQADAPAAVRYPRGTGTGAPVSDGMETVEIGKGIIRREGEKTAFIAFGSMVATALAVAEKLNATVADMRFVKPIDEELIVRLARSHDRIVTLEENAEQGGAGGAVLEVLAKHGICKPVLLLGVADTVTEHGDPKKLLDDLGLSAEAVERRVREWLPDRDAAN

SEQ ID NO: 3262 - DNA, 1529 bp, Neisseria meningitidis
atggcggcggcagacaaactcttgggcagcgaccgccgcagcgtcgccatcatcggcgacggcgcgatgacggcggggcaggcgtttgaagccttgaattgcgcagcgatatggatgtrgatttgctrgtcgtcctcaacgacaacgaaatgtcgatttcccccaacgtcggcgcgctgccgaaataccttgccagcaacgtcgtgcgcgatatgcacggcctgttgagtaccgtcaaagcgcaaacgggcaaggtattagacaaaatacccggcgcgatggagtttgcccaaaaagtcgaacacaaaatcaaaacccttgccgaagaagccgaacacgccaaacagtcgctgtctttgtttgaaaacttcggcttccgctacaccggccccgtggacggacacaacgtcgaaaatctggtggacgtattgaaagacttgcgcagccgcaaaggccctcagttgctgcacgtcatcaccaaaaagggcaacggctacaaactcgccgaaaacgaccccgtcaaataccacgccgtcgccaacctgcctaaagaaagcgcggcgcaaatgccgtctgaaaaagaacccaagcccgccgccaaaccgacctatacccaagtgttcggcaaatggctgtgcgaccgggcggcggcagattcccgactggttgcgattacccccgccatgcgcgagggcagcggcttggttgagtttgaacaacgattccccgaccgctatttcgatgtcggcatcgccgagcagcacgccgttacctttgccggcggtttggcttgcgaagggatgaagcccgtcgtggcgatttattccacctttttacaacgcgcctacgaccaactggtgcacgacatcgccctgcaaaacctacccgttttgtttgccgtcgaccgcgcgggcatcgtcggcgcggacggcccgacccatgccggtctgtacgatttgagctttttgcgctgcgtgccgaacatgattgtcgccgcgccgagcgatgaaaacgaatgccgcctgttgctttcgacctgctatcaggcagacgcgcccgccgccgtccgctatccgcgcggcacgggtacgggcgcgccggtttcagacggcatggaaaccgtggaaatcggcaagggcattatccgccgcgaaggtgagaaaaccgcattcattgccttcggcagtatggtcgcccccgcattggcggttgccgaaaaactgaacgccaccgtcgccgatatgcgcttcgtcaaaccgatagacgaagagttgattgtccgccttgcccgaagccacgaccgcatcgttacccttgaagaaaacgccgaacagggcggcgcaggcggcgcggtgctggaagtattggcgaaacacggcatctgcaaacccgttttgcttttgggcgttgccgataccgtaaccggacacggcgatccgaaaaaacttttagacgatttgggcttgagtgccgaagcggtggaacggcgtgtgcgcgcgtggctgtcggatcgggatgcggcaaattaa

SEQ ID NO: 3263 - protein, 509 aa, Neisseria meningitidis
  misc_feature (36)..(36): Xaa can be any naturally occurring amino acid
MAAADKLLGSDRRSVAIIGDGAMTAGQAFEALNCAXDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLKDLRSRKGPQLLHVITKKGNGYKLAENDPVKYHAVANLPKESAAQMPSEKEPKPAAKPTYTQVFGKWLCDRAAADSRLVAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCVPNMIVAAPSDENECRLLLSTCYQADAPAAVRYPRGTGTGAPVSDGMETVEIGKGIIRREGEKTAFIAFGSMVAPALAVAEKLNATVADMRFVKPIDEELIVRLARSHDRIVTLEENAEQGGAGGAVLEVLAKHGICKPVLLLGVADTVTGHGDPKKLLDDLGLSAEAVERRVRAWLSDRDAAN

SEQ ID NO: 3264 - DNA, 1530 bp, Neisseria meningitidis
atggcggcggcggacaaacagttgggcagcgaccgccgcagcgtcgccatcatcggcgacggcgcgatgacggcgggtcaggcgtttgaagccttgaactgcgcgggcgatatggatgtggatttgctggtcgtcctcaacgacaacgaaatgtcgatttcccccaacgtcggtgcgttgcccaaataccttgccagcaacgtcgtgcgcgatatgcacggactgttgagtaccgtcaaagcgcaaacgggcaaggtattagacaaaatacccggcgcgatggagtttgcccaaaaagtcgaacataaaatcaaaacccttgccgaagaagccgaacacgccaaacagtcactgtctttgtttgaaaacttcggcttccgctataccggccccgtggacggacacaacgtcgaaaatctggtcgatgtattggaagacctgcgcggacgcaaaggcccgcagcttctgcacgtcatcaccaaaaagggcaacggctacaaactcgccgaaaacgatcccgtcaaataccacgccgtcgccaacctgcctaaagaaagcgcggcgcaaatgccgtctgaaaaagaacccaagcccgccgccaaaccgacctatacccaagtgttcggcaaatggctgtgcgaccgggcggcggcagattcccgactggttgcgattacccccgccatgcgcgagggcagcggcttggttgagtttgaacaacgattccccgaccgctatttcgatgtcggcatcgccgagcagcacgccgttacctttgccggcggtttggcttgcgaagggatgaagcccgtcgtggcgatttattccacctttttacaacgcgcctacgaccaactggtgcacgacatcgccctgcaaaacctgcccgttttgtttgccgtcgaccgcgcgggcatcgtcggcgcggacggcccgacccatgccggtttgtacgatttaagctttttgcgctgcattccgaatatgattgtcgccgcgccgagcgatgaaaatgaatgccgcctgctgctttcgacctgctatcaggcagacgcgcccgccgccgtccgctatccgcgcggcacgggtacgggcgtgccggtttcagacggcatggaaaccgtggaaatcggcaagggcattatccgccgcgaaggtgagaaaaccgcattcattgccttcggcagtatggtcgcccctgcattggcggtcgccggaaaactgaacgccaccgtcgccgatatgcgcttcgtcaaaccgatagacgaagagttgattgtccgccttgcccgaagccacgaccgcatcgttacccttgaagaaaacgccgaacagggcggcgcaggcagcgcggtgctggaagtgttggcgaaacacggcatctgcaaacccgtcttgcttttgggcgttgccgataccgtaaccggacacggcgatccgaaaaaacttttagacgatttgggcttgagtgccgaagcggtggaacggcgtgtgcgcgcgtggctgtcggatcgggatgcggcaaattaa

SEQ ID NO: 3265 - protein, 193 aa, Neisseria meningitidis
MKHTVSASVILLLTACAQLPQNNENLWQPSEHTRSFTAEGRLAVKAEGKGSYANFDWTYQPPVETININTPLGSTLGQLCQDRDGALAVDGKGNVYQAESAEELSRQLVGFKLPIQYLHIWADGRPVAGAPYRILPDGILEQYGWTVGRTADSGGQVRTLQLNNGNLNIRLVFTEIGMPSETETQEQCAARIQ

SEQ ID NO: 3266 - DNA, 21 bp, Artificial Sequence
  Synthetic Construct
cgaatccggacggcaggactc

SEQ ID NO: 3267 - DNA, 22 bp, Artificial Sequence
  Synthetic Construct
ggcagggaatggcggattaaag

SEQ ID NO: 3268 - DNA, 20 bp, Artificial Sequence
  Synthetic Construct
aaaatgcctctccacggctg

SEQ ID NO: 3269 - DNA, 24 bp, Artificial Sequence
  Synthetic Construct
ctgcgccctgtgttaaaatcccct

SEQ ID NO: 3270 - DNA, 20 bp, Artificial Sequence
  Synthetic Construct
caaataagaaaggaattttg

SEQ ID NO: 3271 - DNA, 27 bp, Artificial Sequence
  Synthetic Construct
ggtatcgcaaaacttcgccttaatgcg

SEQ ID NO: 3272 - DNA, 21 bp, Artificial Sequence
  Synthetic Construct
cgaatccggacggcaggactc

SEQ ID NO: 3273 - DNA, 20 bp, Artificial Sequence
  Synthetic Construct
cgaccgcgcctttgggactg

SEQ ID NO: 3274 - DNA, 22 bp, Artificial Sequence
  Synthetic Construct
ggcagggaatggcggattaaag

SEQ ID NO: 3275 - DNA, 20 bp, Artificial Sequence
  Synthetic Construct
tctttgagtttgatccaacc

SEQ ID NO: 3276 - DNA, 20 bp, Artificial Sequence
  Synthetic Construct
aaaatgcctctccacggctg

SEQ ID NO: 3277 - DNA, 24 bp, Artificial Sequence
  Synthetic Construct
ctgcgccctgtgttaaaatcccct

SEQ ID NO: 3278 - DNA, 20 bp, Artificial Sequence
  Synthetic Construct
atccttccgcctcggctgcg

SEQ ID NO: 3279 - DNA, 20 bp, Artificial Sequence
  Synthetic Construct
aaaacagcggcacaatcgac

SEQ ID NO: 3280 - DNA, 20 bp, Artificial Sequence
  Synthetic Construct
ataagggctacctcaaactc

SEQ ID NO: 3281 - DNA, 20 bp, Artificial Sequence
  Synthetic Construct
gcgcgtggattatttttggg

SEQ ID NO: 3282 - DNA, 20 bp, Artificial Sequence
  Synthetic Construct
caaataagaaaggaattttg

SEQ ID NO: 3283 - DNA, 27 bp, Artificial Sequence
  Synthetic Construct
ggtatcgcaaaacttcgccttaatgcg

SEQ ID NO: 3284 - DNA, 20 bp, Artificial Sequence
  Synthetic Construct
cccaaggtaatgtagtgccg

SEQ ID NO: 3285 - DNA, 20 bp, Artificial Sequence
  Synthetic Construct
taaaaaaaagttcgacaggg

SEQ ID NO: 3286 - DNA, 20 bp, Artificial Sequence
  Synthetic Construct
ccgtccgcctgtcgtcgccc

SEQ ID NO: 3287 - DNA, 20 bp, Artificial Sequence
  Synthetic Construct
tcgttccggcggggtcgggg

SEQ ID NO: 3288 - DNA, 15 bp, Artificial Sequence
  Synthetic Construct
cgcggatcccatatg

SEQ ID NO: 3289 - DNA, 15 bp, Artificial Sequence
  Synthetic Construct
cgcggatccgctagc

SEQ ID NO: 3290 - DNA, 17 bp, Artificial Sequence
  Synthetic Construct
ccggaattctagatatc

SEQ ID NO: 3291 - DNA, 17 bp, Artificial Sequence
  Synthetic Construct
ccggaattctagctagc

SEQ ID NO: 3292 - DNA, 10 bp, Artificial Sequence
  Synthetic Construct
cccgctcgag

SEQ ID NO: 3293 - DNA, 10 bp, Artificial Sequence
  Synthetic Construct
cccgctcgag

SEQ ID NO: 3294 - DNA, 12 bp, Artificial Sequence
  Synthetic Construct
aaaaaagaattc

SEQ ID NO: 3295 - DNA, 12 bp, Artificial Sequence
  Synthetic Construct
aaaaaaggatcc

SEQ ID NO: 3296 - DNA, 12 bp, Artificial Sequence
  Synthetic Construct
aaaaaactgcag

SEQ ID NO: 3297 - DNA, 12 bp, Artificial Sequence
  Synthetic Construct
aaaaaatctaga

SEQ ID NO: 3298 - DNA, 9 bp, Artificial Sequence
  Synthetic Construct
aaagcatgc

SEQ ID NO: 3299 - DNA, 12 bp, Artificial Sequence
  Synthetic Construct
aaaaaagaatcc

SEQ ID NO: 3300 - DNA, 32 bp, Artificial Sequence
  Synthetic Construct
cgcggatcccatatgtggatggtgctggtcat

SEQ ID NO: 3301 - DNA, 26 bp, Artificial Sequence
  Synthetic Construct
cccgctcgagtgccgtcttgtcccac

SEQ ID NO: 3302 - DNA, 29 bp, Artificial Sequence
  Synthetic Construct
cgcggatcccatatggtcgtattcgtggc

SEQ ID NO: 3303 - DNA, 28 bp, Artificial Sequence
  Synthetic Construct
cccgctcgagaaaatcatgaacacgcgc

SEQ ID NO: 3304 - DNA, 31 bp, Artificial Sequence
  Synthetic Construct
cgcggatcccatatggacaatattgacatgt

SEQ ID NO: 3305 - DNA, 25 bp, Artificial Sequence
  Synthetic Construct
cccgctcgagcatcacatccgcccg

SEQ ID NO: 3306 - DNA, 28 bp, Artificial Sequence
  Synthetic Construct
cgcggatcccatatgctgctggtgctgg

SEQ ID NO: 3307 - DNA, 27 bp, Artificial Sequence
  Synthetic Construct
cccgctcgagagttccggctttgatgt

SEQ ID NO: 3308 - DNA, 32 bp, Artificial Sequence
  Synthetic Construct
cgcggatcccatatggccgacaacagcatcat

SEQ ID NO: 3309 - DNA, 29 bp, Artificial Sequence
  Synthetic Construct
cccgctcgagaaggcgttcatgatataag

SEQ ID NO: 3310 - DNA, 31 bp, Artificial Sequence
  Synthetic Construct
cgcggatcccatatgaacaacagacattttg

SEQ ID NO: 3311 - DNA, 27 bp, Artificial Sequence
  Synthetic Construct
cccgctcgagcctgtccggtaaaagac

SEQ ID NO: 3312 - DNA, 27 bp, Artificial Sequence
  Synthetic Construct
cgcggatcccatatgccccgcgctgct

SEQ ID NO: 3313 - DNA, 28 bp, Artificial Sequence
  Synthetic Construct
cccgctcgagtggcttttgccacgtttt

SEQ ID NO: 3314 - DNA, 30 bp, Artificial Sequence
  Synthetic Construct
cgcggatcccatatgaagacacaccgcaag

SEQ ID NO: 3315 - DNA, 25 bp, Artificial Sequence
  Synthetic Construct
cccgctcgagggcggtcagtacggt

SEQ ID NO: 3316 - DNA, 28 bp, Artificial Sequence
  Synthetic Construct
cgcggatcccatatgctcgcccgttgcc

SEQ ID NO: 3317 - DNA, 26 bp, Artificial Sequence
  Synthetic Construct
cccgctcgagagcggggaagaggcac

SEQ ID NO: 3318 - DNA, 29 bp, Artificial Sequence
  Synthetic Construct
cgcggatcccatatgcctttgaccatgct

SEQ ID NO: 3319 - DNA, 30 bp, Artificial Sequence
  Synthetic Construct
cccgctcgagctgattcggcaaaaaaatct

SEQ ID NO: 3320 - DNA, 29 bp, Artificial Sequence
  Synthetic Construct
cgcggatcccatatgcagcagaggcagtt

SEQ ID NO: 3321 - DNA, 25 bp, Artificial Sequence
  Synthetic Construct
cccgctcgaggacgaggcgaacgcc

SEQ ID NO: 3322 - DNA, 32 bp, Artificial Sequence
  Synthetic Construct
aaagaattcctgccagccggcaagaccccggc

SEQ ID NO: 3323 - DNA, 33 bp, Artificial Sequence
  Synthetic Construct
aaactgcagtcagcgggcggggacaatgcccat

SEQ ID NO: 3324 - DNA, 32 bp, Artificial Sequence
  Synthetic Construct
aaagaattcaaagaatattcggcatggcaggc

SEQ ID NO: 3325 - DNA, 33 bp, Artificial Sequence
  Synthetic Construct
aaactgcagttacccccaaatcactttaactga

SEQ ID NO: 3326 - DNA, 32 bp, Artificial Sequence
  Synthetic Construct
aaagaattctgcgccacccaacagcctgctcc

SEQ ID NO: 3327 - DNA, 33 bp, Artificial Sequence
  Synthetic Construct
aaactgcagtcagaacgcgatatagctgttcgg

SEQ ID NO: 3328 - DNA, 29 bp, Artificial Sequence
  Synthetic Construct
cgcggatcccatatggtctcccttcgctt

SEQ ID NO: 3329 - DNA, 28 bp, Artificial Sequence
  Synthetic Construct
cccgctcgagatgtaagacggggacaac

SEQ ID NO: 3330 - DNA, 28 bp, Artificial Sequence
  Synthetic Construct
cgcggatcccatatgcggcgaaacgtgc

SEQ ID NO: 3331 - DNA, 30 bp, Artificial Sequence
  Synthetic Construct
cccgctcgagctggttttttgatatttgtg

SEQ ID NO: 3332 - DNA, 28 bp, Artificial Sequence
  Synthetic Construct
cgcggatcccatatggcggcggcagaca

SEQ ID NO: 3333 - DNA, 27 bp, Artificial Sequence
  Synthetic Construct
cccgctcgagatttgccgcatcccgat

SEQ ID NO: 3334 - DNA, 32 bp, Artificial Sequence
  Synthetic Construct
cgcggatcccatatggccgaaaacagctacgg

SEQ ID NO: 3335 - DNA, 30 bp, Artificial Sequence
  Synthetic Construct
cccgctcgagtttgacgatttggttcaatt

SEQ ID NO: 3336 - DNA, 28 bp, Artificial Sequence
  Synthetic Construct
cgcggatcccatatgctgaagccgtgcg

SEQ ID NO: 3337 - DNA, 26 bp, Artificial Sequence
  Synthetic Construct
cccgctcgagccggactgcgtatcgg

SEQ ID NO: 3338 - DNA, 29 bp, Artificial Sequence
  Synthetic Construct
cgcggatcccatatgaccgatttccgcca

SEQ ID NO: 3339 - DNA, 27 bp, Artificial Sequence
  Synthetic Construct
cccgctcgagttctacgccgtactgcc

SEQ ID NO: 3340 - DNA, 28 bp, Artificial Sequence
  Synthetic Construct
cgcggatcccatatgccgtccgaaccgc

SEQ ID NO: 3341 - DNA, 27 bp, Artificial Sequence
  Synthetic Construct
cccgctcgagtaggatgacgaggtagg

SEQ ID NO: 3342 - DNA, 31 bp, Artificial Sequence
  Synthetic Construct
cgcggatcccatatgttcgtgcgcgaaccgc

SEQ ID NO: 3343 - DNA, 29 bp, Artificial Sequence
  Synthetic Construct
cccgctcgaggcccaaaaactctttcaaa

SEQ ID NO: 3344 - DNA, 31 bp, Artificial Sequence
  Synthetic Construct
cgcggatcccatatgacgatgatttgcttgc

SEQ ID NO: 3345 - DNA, 29 bp, Artificial Sequence
  Synthetic Construct
cccgctcgagtttgcagcctgcatttgac

SEQ ID NO: 3346 - DNA, 36 bp, Artificial Sequence
  Synthetic Construct
aaaaaaggtaccatggttgtttcaaatcaaaatatc

SEQ ID NO: 3347 - DNA, 33 bp, Artificial Sequence
  Synthetic Construct
aaactgcagttattgcgcttcaccttccgccgc

SEQ ID NO: 3348 - DNA, 41 bp, Artificial Sequence
  Synthetic Construct
aaaaaaggtaccgcaaaagtgcatggcggcttggacggtgc

SEQ ID NO: 3349 - DNA, 42 bp, Artificial Sequence
  Synthetic Construct
aaaaaactgcagttaatcctgcaacacgaattcgcccgtccg

SEQ ID NO: 3350 - DNA, 29 bp, Artificial Sequence
  Synthetic Construct
cgcggatcccatatgccgtccgactagag

SEQ ID NO: 3351 - DNA, 27 bp, Artificial Sequence
  Synthetic Construct
cccgctcgagatgcgctacggtagcca

SEQ ID NO: 3352 - DNA, 32 bp, Artificial Sequence
  Synthetic Construct
aaagaattcatgtcggcaatgctcccgacaag

SEQ ID NO: 3353 - DNA, 33 bp, Artificial Sequence
  Synthetic Construct
aaactgcagtcactcggcgacccacaccgtgaa

SEQ ID NO: 3354 - DNA, 30 bp, Artificial Sequence
  Synthetic Construct
cgcggatcccatatggtcatcatacaggcg

SEQ ID NO: 3355 - DNA, 29 bp, Artificial Sequence
  Synthetic Construct
cccgctcgagtccgaaaaagcccattttg

SEQ ID NO: 3356 - DNA, 35 bp, Artificial Sequence
  Synthetic Construct
aaagaattcatgctcaacaaaggcgaagaattgcc

SEQ ID NO: 3357 - DNA, 33 bp, Artificial Sequence
  Synthetic Construct
aaactgcagtcaagattcgacggggatgatgcc

SEQ ID NO: 3358 - DNA, 35 bp, Artificial Sequence
  Synthetic Construct
aaagaattcatgcgggcgcaggcgtttgatcagcc

SEQ ID NO: 3359 - DNA, 33 bp, Artificial Sequence
  Synthetic Construct
aaactgcagaaggcgtatctgaaaaaatggcag

SEQ ID NO: 3360 - DNA, 27 bp, Artificial Sequence
  Synthetic Construct
cgcggatcccatatgggcgcgggctgg

SEQ ID NO: 3361 - DNA, 27 bp, Artificial Sequence
  Synthetic Construct
cccgctcgagaatcgggccatcttcga

SEQ ID NO: 3362 - DNA, 35 bp, Artificial Sequence
  Synthetic Construct
aaaaaagaattcatggctttggtggcggaggaaac

SEQ ID NO: 3363 - DNA, 36 bp, Artificial Sequence
  Synthetic Construct
aaaaaagtcgactcaggcggcgtttttcaccttcct

SEQ ID NO: 3364 - DNA, 38 bp, Artificial Sequence
  Synthetic Construct
aaaaaagaattcgtggcggaggaaacggaaatatccgc

SEQ ID NO: 3365 - DNA, 42 bp, Artificial Sequence
  Synthetic Construct
aaaaaactgcagttagctgtttttggaaacgccgtccaaccc

SEQ ID NO: 3366 - DNA, 32 bp, Artificial Sequence
  Synthetic Construct
cgcggatcccatatgtgtatgccatataagat

SEQ ID NO: 3367 - DNA, 26 bp, Artificial Sequence
  Synthetic Construct
cccgctcgagcaccggattgtccgac

SEQ ID NO: 3368 - DNA, 30 bp, Artificial Sequence
  Synthetic Construct
cgcggatcccatatgccgtcttacttcatc

SEQ ID NO: 3369 - DNA, 30 bp, Artificial Sequence
  Synthetic Construct
cccgctcgagatcaccaatgccgattattt

SEQ ID NO: 3370 - DNA, 38 bp, Artificial Sequence
  Synthetic Construct
aaaaaagaattcggcggcattttcatcgacaccttcct

SEQ ID NO: 3371 - DNA, 39 bp, Artificial Sequence
  Synthetic Construct
aaaaaactgcagtcagacgaacatctgcacaaacgcaat

SEQ ID NO: 3372 - DNA, 38 bp, Artificial Sequence
  Synthetic Construct
aaagaattcgcgtccgggctggtttggttttacaattc

SEQ ID NO: 3373 - DNA, 33 bp, Artificial Sequence
  Synthetic Construct
aaactgcagctattcttcggattctttttcggg

SEQ ID NO: 3374 - DNA, 38 bp, Artificial Sequence
  Synthetic Construct
aaagaattcatgaaaccactggacctaaatttcatctg

SEQ ID NO: 3375 - DNA, 30 bp, Artificial Sequence
  Synthetic Construct
aaactgcagtcacttatcctccaatgcctc

SEQ ID NO: 3376 - DNA, 32 bp, Artificial Sequence
  Synthetic Construct
aaagaattcatgtggttgttgaagttgcctgc

SEQ ID NO: 3377 - DNA, 30 bp, Artificial Sequence
  Synthetic Construct
aaactgcagttacgcggattcggcagttgg

SEQ ID NO: 3378 - DNA, 38 bp, Artificial Sequence
  Synthetic Construct
aaagaattctatcacccagaatatgaatacggctaccg

SEQ ID NO: 3379 - DNA, 30 bp, Artificial Sequence
  Synthetic Construct
aaactgcagttatacttgggcgcaacatga

SEQ ID NO: 3380 - DNA, 31 bp, Artificial Sequence
  Synthetic Construct
cgcggatcccatatgggtaaagggcaggact

SEQ ID NO: 3381 - DNA, 29 bp, Artificial Sequence
  Synthetic Construct
cccgctcgagcaaagccttaaacgcttcg

SEQ ID NO: 3382 - DNA, 35 bp, Artificial Sequence
  Synthetic Construct
aaaaaaggtacctatttggcatcaaaagaaggcgg

SEQ ID NO: 3383 - DNA, 30 bp, Artificial Sequence
  Synthetic Construct
aaactgcagttactccacccgataaccgcg

SEQ ID NO: 3384 - DNA, 31 bp, Artificial Sequence
  Synthetic Construct
aaagaattcatgggcggtaaaacctttatgc

SEQ ID NO: 3385 - DNA, 30 bp, Artificial Sequence
  Synthetic Construct
aaactgcagttacgccgcacacgcaatcgc

SEQ ID NO: 3386 - DNA, 41 bp, Artificial Sequence
  Synthetic Construct
aaaaaagaattcaagctattaggcgtgccgattgtgattca

SEQ ID NO: 3387 - DNA, 39 bp, Artificial Sequence
  Synthetic Construct
aaaaaactgcagttacgcctgcaagatgcccagcttgcc

SEQ ID NO: 3388 - DNA, 38 bp, Artificial Sequence
  Synthetic Construct
aaaaaagaattcatgtttttatggctcgcacatttcag

SEQ ID NO: 3389 - DNA, 39 bp, Artificial Sequence
  Synthetic Construct
aaaaaactgcagtcagcggattttgagggtactcaaacc

SEQ ID NO: 3390 - DNA, 29 bp, Artificial Sequence
  Synthetic Construct
cgcggatcccatatgccgcccaaaatcac

SEQ ID NO: 3391 - DNA, 27 bp, Artificial Sequence
  Synthetic Construct
cccgctcgagtgcgcataccaaagcca

SEQ ID NO: 3392 - DNA, 29 bp, Artificial Sequence
  Synthetic Construct
cgcggatcccatatgcgcatagtcgagca

SEQ ID NO: 3393 - DNA, 27 bp, Artificial Sequence
  Synthetic Construct
cccgctcgagagcaaaacggcggtacg

SEQ ID NO: 3394 - DNA, 35 bp, Artificial Sequence
  Synthetic Construct
aaagaattcatggaaatacccgtaccgccgagtcc

SEQ ID NO: 3395 - DNA, 33 bp, Artificial Sequence
  Synthetic Construct
aaactgcagtcagcgcagggggtagcccaagcc

SEQ ID NO: 3396 - DNA, 29 bp, Artificial Sequence
  Synthetic Construct
aaagaattcatgttttttatttcaatccg

SEQ ID NO: 3397 - DNA, 30 bp, Artificial Sequence
  Synthetic Construct
aaactgcagtcaaatctgtttcgacaatgc

SEQ ID NO: 3398 - DNA, 32 bp, Artificial Sequence
  Synthetic Construct
aaagaattcatgcagaattttggcaaagtggc

SEQ ID NO: 3399 - DNA, 30 bp, Artificial Sequence
  Synthetic Construct
aaactgcagctatggctcgtcataccgggc

SEQ ID NO: 3400 - DNA, 35 bp, Artificial Sequence
  Synthetic Construct
aaagaattcatgccgtcacggaagcgcatcaactc

SEQ ID NO: 3401 - DNA, 33 bp, Artificial Sequence
  Synthetic Construct
aaactgcagttatcccggccataccgccgaaca

SEQ ID NO: 3402 - DNA, 35 bp, Artificial Sequence
  Synthetic Construct
aaagaattcatgtcctttcatttgaacatggacgg

SEQ ID NO: 3403 - DNA, 33 bp, Artificial Sequence
  Synthetic Construct
aaactgcagtcaacgccgcaggcactaacgccc

SEQ ID NO: 3404 - DNA, 32 bp, Artificial Sequence
  Synthetic Construct
aaagaattcatggctcgtcataccgggcaggg

SEQ ID NO: 3405 - DNA, 36 bp, Artificial Sequence
  Synthetic Construct
aaactgcagtcaaaggaaaaggccgtctgaaaagcg

SEQ ID NO: 3406 - DNA, 36 bp, Artificial Sequence
  Synthetic Construct
aaagaattcatggacacttcaaaacaaacactgttg

SEQ ID NO: 3407 - DNA, 33 bp, Artificial Sequence
  Synthetic Construct
aaactgcagtcagcccaaataccagaatttcag

SEQ ID NO: 3408 - DNA, 35 bp, Artificial Sequence
  Synthetic Construct
aaagaattcgatgaacgcagcccagcatggatacg

SEQ ID NO: 3409 - DNA, 30 bp, Artificial Sequence
  Synthetic Construct
aaactgcagttacgacattctgatttggca

SEQ ID NO: 3410 - DNA, 38 bp, Artificial Sequence
  Synthetic Construct
aaaaaagaattcggcctgatgattttggaagtcaacac

SEQ ID NO: 3411 - DNA, 39 bp, Artificial Sequence
  Synthetic Construct
aaaaaactgcagttatcctttaaatacggggacgagttc

SEQ ID NO: 3412 - DNA, 31 bp, Artificial Sequence
  Synthetic Construct
cgcggatcccatatgtccgcaaacgaatacg

SEQ ID NO: 3413 - DNA, 28 bp, Artificial Sequence
  Synthetic Construct
cccgctcgaggtgttctgccagtttcag

SEQ ID NO: 3414 - DNA, 44 bp, Artificial Sequence
  Synthetic Construct
aaaaaagaattcctgatgattttggaagtcaacacccattatcc

SEQ ID NO: 3415 - DNA, 39 bp, Artificial Sequence; identical to SEQ ID NO: 3411
  Synthetic Construct

SEQ ID NO: 3416 - DNA, 44 bp, Artificial Sequence
  Synthetic Construct
aaaaaagaattcgatacccaagcccccgccggcacaaactactg

SEQ ID NO: 3417 - DNA, 51 bp, Artificial Sequence
  Synthetic Construct
aaaaaactgcagttacgcgtcgcctttaaagtatttgagcaggctggagac

SEQ ID NO: 3418 - DNA, 29 bp, Artificial Sequence
  Synthetic Construct
aaagaattcatgttgccgggcttcaaccg

SEQ ID NO: 3419 - DNA, 33 bp, Artificial Sequence
  Synthetic Construct
aaactgcagttagcggtacaggtgtttgaagca

SEQ ID NO: 3420 - DNA, 41 bp, Artificial Sequence
  Synthetic Construct
aaaaaagaattcggtaacacattcggcagcttagacggtgg

SEQ ID NO: 3421 - DNA, 33 bp, Artificial Sequence; identical to SEQ ID NO: 3419
  Synthetic Construct

SEQ ID NO: 3422 - DNA, 32 bp, Artificial Sequence
  Synthetic Construct
aaagaattcatgtattatcgccgggttatggg

SEQ ID NO: 3423 - DNA, 33 bp, Artificial Sequence
  Synthetic Construct
aaactgcagctagcccaaagatttgaagtgttc

SEQ ID NO: 3424 - DNA, 32 bp, Artificial Sequence
  Synthetic Construct
cgcggatcccatatgtgttcggaacaaaccgc

SEQ ID NO: 3425 - DNA, 28 bp, Artificial Sequence
  Synthetic Construct
cccgctcgaggcggagcagtttttcaaa

SEQ ID NO: 3426 - DNA, 31 bp, Artificial Sequence
  Synthetic Construct
cgcggatcccatatggcttccatcacttcgc

SEQ ID NO: 3427 - DNA, 26 bp, Artificial Sequence
  Synthetic Construct
cccgctcgagcatccgcgaaatcgtc

SEQ ID NO: 3428 - DNA, 36 bp, Artificial Sequence
  Synthetic Construct
aaaaaaggtaccatggtcgaagaactggaactgctg

SEQ ID NO: 3429 - DNA, 33 bp, Artificial Sequence
  Synthetic Construct
aaactgcagttaaagccgggtaacgctcaatac

SEQ ID NO: 3430 - DNA, 35 bp, Artificial Sequence
  Synthetic Construct
aaagtcgacatgtgtgagttcaaggatattataag

SEQ ID NO: 3431 - DNA, 35 bp, Artificial Sequence
  Synthetic Construct
aaagcatgcctattttttgttgtaataatcaaatc

SEQ ID NO: 3432 - DNA, 32 bp, Artificial Sequence; identical to SEQ ID NO: 3030
  Synthetic Construct

SEQ ID NO: 3433 - DNA, 29 bp, Artificial Sequence
  Synthetic Construct
cccgctcgagataataatatcccgcgccc

SEQ ID NO: 3434 - DNA, 34 bp, Artificial Sequence
  Synthetic Construct
cgcggatcccatatggtcatgattaaaatccgca

SEQ ID NO: 3435 - DNA, 30 bp, Artificial Sequence
  Synthetic Construct
cccgctcgagaatcttggtagattggattt

SEQ ID NO: 3436 - DNA, 32 bp, Artificial Sequence
  Synthetic Construct
aaagaattcatgtcgggcaatgcctcctctcc

SEQ ID NO: 3437 - DNA, 27 bp, Artificial Sequence
  Synthetic Construct
aaactgcagtcacgccgtttcaagacg

SEQ ID NO: 3438 - DNA, 41 bp, Artificial Sequence
  Synthetic Construct
aaaaaagaattcacggcaggcagcaccgccgcacaggtttc

SEQ ID NO: 3439 - DNA, 48 bp, Artificial Sequence
  Synthetic Construct
aaaaaactgcagttattttgccacgtcggtttctccggtgaacaacgc

SEQ ID NO: 3440 - DNA, 28 bp, Artificial Sequence
  Synthetic Construct
cgcggatcccatatgccgtctgaaaccc

SEQ ID NO: 3441 - DNA, 27 bp, Artificial Sequence
  Synthetic Construct
cccgctcgagatattccgccgaatgcc

SEQ ID NO: 3442 - DNA, 38 bp, Artificial Sequence
  Synthetic Construct
aaagaattcatggaaatatggaatatgttggacacttg

SEQ ID NO: 3443 - DNA, 30 bp, Artificial Sequence
  Synthetic Construct
aaactgcagttaaagtgtttcggagccggc

SEQ ID NO: 3444 - DNA, 38 bp, Artificial Sequence
  Synthetic Construct
aaaaaagaattcaaggaactgattatgtgtctgtcggg

SEQ ID NO: 3445 - DNA, 30 bp, Artificial Sequence; identical to SEQ ID NO: 3443
  Synthetic Construct

SEQ ID NO: 3446 - DNA, 29 bp, Artificial Sequence
  Synthetic Construct
cgcggatcccatatgactgacaacgcact

SEQ ID NO: 3447 - DNA, 26 bp, Artificial Sequence
  Synthetic Construct
cccgctcgaggaccgcgttgtcgaaa

SEQ ID NO: 3448 - DNA, 29 bp, Artificial Sequence
  Synthetic Construct
cgcggatcccatatgaaacaactccgcga

SEQ ID NO: 3449 - DNA, 28 bp, Artificial Sequence
  Synthetic Construct
cccgctcgaggaattttgcaccggattg

SEQ ID NO: 3450 - DNA, 35 bp, Artificial Sequence
  Synthetic Construct
aaagaattcatggaacccttcaaaaccttaatttg

SEQ ID NO: 3451 - DNA, 36 bp, Artificial Sequence
  Synthetic Construct
aaaaaactgcagtcaccatgtcggcatttgaaaaac

SEQ ID NO: 3452 - DNA, 30 bp, Artificial Sequence
  Synthetic Construct
cgcggatcccatatgtcccaagaaatcctc

SEQ ID NO: 3453 - DNA, 28 bp, Artificial Sequence
  Synthetic Construct
cccgctcgagcagtttgaccgaatgttc

SEQ ID NO: 3454 - DNA, 35 bp, Artificial Sequence
  Synthetic Construct
cgcggatcccatatgaaatacaaaagaatcgtatt

SEQ ID NO: 3455 - DNA, 29 bp, Artificial Sequence
  Synthetic Construct
cccgctcgagaaattcggtcagaagcagg

SEQ ID NO: 3456 - DNA, 38 bp, Artificial Sequence
  Synthetic Construct
aaaaaaggtaccatgattacccatccccaattcgatcc

SEQ ID NO: 3457 - DNA, 36 bp, Artificial Sequence
  Synthetic Construct
aaaaaactgcagtcagtgctgttttttcatgccgaa

SEQ ID NO: 3458 - DNA, 38 bp, Artificial Sequence
  Synthetic Construct
aaaaaagaattcggccgcaaacacggcatcggcttcct

SEQ ID NO: 3459 - DNA, 39 bp, Artificial Sequence
  Synthetic Construct
aaaaaactgcagttaagcgggatgacgcggcagcatacc

SEQ ID NO: 3460 - DNA, 38 bp, Artificial Sequence
  Synthetic Construct
aaaaaagaattcaactcaggcgaaggagtgcttgtggc

SEQ ID NO: 3461 - DNA, 36 bp, Artificial Sequence
  Synthetic Construct
aaaaaatctagatcagtttagggatagcaggcgtac

SEQ ID NO: 3462 - DNA, 38 bp, Artificial Sequence
  Synthetic Construct
aaagaattcatgagcttcaaaaccgatgccgaaatcgc

SEQ ID NO: 3463 - DNA, 33 bp, Artificial Sequence
  Synthetic Construct
aaactgcagtcagaacaagccgtgaatcacgcc

SEQ ID NO: 3464 - DNA, 30 bp, Artificial Sequence
  Synthetic Construct
cgcggatcccatatgcgtgccgatttcatg

SEQ ID NO: 3465 - DNA, 27 bp, Artificial Sequence
  Synthetic Construct
cccgctcgagaaactgctgcacatggg

SEQ ID NO: 3466 - DNA, 44 bp, Artificial Sequence
  Synthetic Construct
aaaaaagaattcatgctcagtttcggctttctcggcgttcagac

SEQ ID NO: 3467 - DNA, 39 bp, Artificial Sequence
  Synthetic Construct
aaaaaactgcagtcaaaccccgccgtgtgtttctttaat

SEQ ID NO: 3468 - DNA, 38 bp, Artificial Sequence
  Synthetic Construct
aaaaaagaattcggtctgatcgacgggcgtgccgtaac

SEQ ID NO: 3469 - DNA, 36 bp, Artificial Sequence
  Synthetic Construct
aaaaaatctagatcggcatcggccggcatatgtccg

SEQ ID NO: 3470 - DNA, 42 bp, Artificial Sequence
  Synthetic Construct
aaaaaagaattccgccaagtcgtcattgaccacgacaaagtc

SEQ ID NO: 3471 - DNA, 39 bp, Artificial Sequence
  Synthetic Construct
aaaaaactgcagttaggcatcggcaaataggaaactggg

SEQ ID NO: 3472 - DNA, 38 bp, Artificial Sequence
  Synthetic Construct
aaaaaagaattcactgagcaatcggtggatttggaaac

SEQ ID NO: 3473 - DNA, 39 bp, Artificial Sequence
  Synthetic Construct
aaaaaatctagattaggtaaagctgcggcccatttgcgg

SEQ ID NO: 3474 - DNA, 44 bp, Artificial Sequence
  Synthetic Construct
aaaaaagaattcatggcgttaaaaacatcaaacttggaacacgc

SEQ ID NO: 3475 - DNA, 39 bp, Artificial Sequence
  Synthetic Construct
aaaaaatctagatcagcccttcatacagccttcgttttg

SEQ ID NO: 3476 - DNA, 32 bp, Artificial Sequence
  Synthetic Construct
cgcggatcccatatgctgcttgacaacaaagt

SEQ ID NO: 3477 - DNA, 28 bp, Artificial Sequence
  Synthetic Construct
cccgctcgagaaacttcacgttcacgcc

SEQ ID NO: 3478 - DNA, 30 bp, Artificial Sequence
  Synthetic Construct
cgcggatcccatatgcagaacacaaatccg

SEQ ID NO: 3479 - DNA, 30 bp, Artificial Sequence
  Synthetic Construct
cccgctcgagataaacatcacgctgatagc

SEQ ID NO: 3480 - DNA, 44 bp, Artificial Sequence
  Synthetic Construct
aaaaaagaattcatgaaacaaatccgcaacatcgccatcatcgc

SEQ ID NO: 3481 - DNA, 39 bp, Artificial Sequence
  Synthetic Construct
aaaaaactgcagtcaatccagctttttaaagtggcggcg

SEQ ID NO: 3482 - DNA, 44 bp, Artificial Sequence
  Synthetic Construct
aaaaaagaattcatgaaaaacaaaaccaaagtctgggacctccc

SEQ ID NO: 3483 - DNA, 36 bp, Artificial Sequence
  Synthetic Construct
aaaaaactgcagtcaggacaggagcaggatggcggc

SEQ ID NO: 3484 - DNA, 35 bp, Artificial Sequence
  Synthetic Construct
aaaaaagaattcatggcgtttgcttacggtatgac

SEQ ID NO: 3485 - DNA, 36 bp, Artificial Sequence
  Synthetic Construct
aaaaaactgcagtcagtcatgtttttccgtttcatt

SEQ ID NO: 3486 - DNA, 41 bp, Artificial Sequence
  Synthetic Construct
aaaaaagaattccggacttcggtatcggttccccagcattg

SEQ ID NO: 3487 - DNA, 42 bp, Artificial Sequence
  Synthetic Construct
aaaaaactgcagttacgccgacgaaatactcagacttttcgg

SEQ ID NO: 3488 - DNA, 29 bp, Artificial Sequence
  Synthetic Construct
cgcggatcccatatgactgacaacagccc

SEQ ID NO: 3489 - DNA, 26 bp, Artificial Sequence
  Synthetic Construct
cccgctcgagtcggcttcctttcggg

SEQ ID NO: 3490 - DNA, 38 bp, Artificial Sequence
  Synthetic Construct
aaaaaagaattcatgaaaatcggtatcccacgcgagtc

SEQ ID NO: 3491 - DNA, 39 bp, Artificial Sequence
  Synthetic Construct
aaaaaactgcagttaccctttcttaaacatattcagcat

SEQ ID NO: 3492 - DNA, 35 bp, Artificial Sequence
  Synthetic Construct
aaaaaagaattcgcacagcaaaacggttttgaagc

SEQ ID NO: 3493 - DNA, 36 bp, Artificial Sequence
  Synthetic Construct
aaaaaactgcagtcaagcagccgcgacaaacagccc

SEQ ID NO: 3494 - DNA, 31 bp, Artificial Sequence
  Synthetic Construct
cgcggatcccatatgaggaacgaggaaaaac

SEQ ID NO: 3495 - DNA, 28 bp, Artificial Sequence
  Synthetic Construct
cccgctcgagaaaacacaatatccccgc

SEQ ID NO: 3496 - DNA, 41 bp, Artificial Sequence
  Synthetic Construct
aaaaaagaattcgcggagcagttggcgatggcaaattctgc

SEQ ID NO: 3497 - DNA, 39 bp, Artificial Sequence
  Synthetic Construct
aaaaaatctagattatccacagagattgtttcccagttc

SEQ ID NO: 3498 - DNA, 31 bp, Artificial Sequence
  Synthetic Construct
cgcggatcccatatggacattctggacaaac

SEQ ID NO: 3499 - DNA, 28 bp, Artificial Sequence
  Synthetic Construct
cccgctcgagtttttgcccgccttcttt

SEQ ID NO: 3500 - DNA, 38 bp, Artificial Sequence
  Synthetic Construct
aaaaaaggtaccaccgtgccggatcaggtgcagatgtg

SEQ ID NO: 3501 - DNA, 39 bp, Artificial Sequence
  Synthetic Construct
aaaaaatctagattactctgccaattccacctgctcgtg

SEQ ID NO: 3502 - DNA, 38 bp, Artificial Sequence
  Synthetic Construct
aaaaaagaattccggctggtgcagataatgagccagac

SEQ ID NO: 3503 - DNA, 39 bp, Artificial Sequence; identical to SEQ ID NO: 3501
  Synthetic Construct

SEQ ID NO: 3504 - DNA, 30 bp, Artificial Sequence
  Synthetic Construct
cgcggatcccatatgaaccggacttatgcc

SEQ ID NO: 3505 - DNA, 29 bp, Artificial Sequence
  Synthetic Construct
cccgctcgagtttgtttccgtcaaactgc

SEQ ID NO: 3506 - DNA, 31 bp, Artificial Sequence
  Synthetic Construct
cgcggatccgctagcgctgaagcgacagacg

SEQ ID NO: 3507 - DNA, 29 bp, Artificial Sequence
  Synthetic Construct
cccgctcgagaatatccaatactttcgcg

SEQ ID NO: 3508 - DNA, 31 bp, Artificial Sequence; identical to SEQ ID NO: 3034
  Synthetic Construct

SEQ ID NO: 3509 - DNA, 31 bp, Artificial Sequence
  Synthetic Construct
cccgctcgagttctgtaaaaaaagtatgtgc

SEQ ID NO: 3510 - DNA, 30 bp, Artificial Sequence
  Synthetic Construct
cgcggatcccatatgctgcggcatttagga

SEQ ID NO: 3511 - DNA, 26 bp, Artificial Sequence
  Synthetic Construct
cccgctcgagtacccctgaaggcaac

SEQ ID NO: 3512 - DNA, 32 bp, Artificial Sequence
  Synthetic Construct
aaaaaagaattcatgttgcgggttgctgctgc

SEQ ID NO: 3513 - DNA, 36 bp, Artificial Sequence
  Synthetic Construct
aaaaaactgcagctatcctgcggattggcattgaaa

SEQ ID NO: 3514 - DNA, 30 bp, Artificial Sequence
  Synthetic Construct
cgcggatcccatatggacaatctcgtatgg

SEQ ID NO: 3515 - DNA, 27 bp, Artificial Sequence
  Synthetic Construct
cccgctcgagaggggttagatccttcc

SEQ ID NO: 3516 - DNA, 30 bp, Artificial Sequence
  Synthetic Construct
cgcggatcccatatggcatggttgggtcgt

SEQ ID NO: 3517 - DNA, 32 bp, Artificial Sequence
  Synthetic Construct
cccgctcgagcatatcttttgtatcataaatc

SEQ ID NO: 3518 - DNA, 31 bp, Artificial Sequence
  Synthetic Construct
cgcggatcccatatggcaatggcagaaaacg

SEQ ID NO: 3519 - DNA, 26 bp, Artificial Sequence
  Synthetic Construct
cccgctcgagtacaatccgtgccgcc

SEQ ID NO: 3520 - DNA, 30 bp, Artificial Sequence
  Synthetic Construct
cgcggatcccatatggcggatgacggtgtg

SEQ ID NO: 3521 - DNA, 28 bp, Artificial Sequence
  Synthetic Construct
cccgctcgagaccccgaatatcgaatcc

SEQ ID NO: 3522 - DNA, 28 bp, Artificial Sequence
  Synthetic Construct
cgcggatcccatatggtcgcggtcgatc

SEQ ID NO: 3523 - DNA, 28 bp, Artificial Sequence
  Synthetic Construct
cccgctcgagtaactcatagaatcctgc

SEQ ID NO: 3524 - DNA, 29 bp, Artificial Sequence
  Synthetic Construct
cgcggatccgctagcacggcaaggttaag

SEQ ID NO: 3525 - DNA, 31 bp, Artificial Sequence
  Synthetic Construct
cccgctcgagtttaaaccatctcctcaaaac

SEQ ID NO: 3526 - DNA, 33 bp, Artificial Sequence
  Synthetic Construct
cgcggatcccatatggaattcaggcaccaagta

SEQ ID NO: 3527 - DNA, 25 bp, Artificial Sequence
  Synthetic Construct
cccgctcgagggcttcccgcgtgtc

SEQ ID NO: 3528 - DNA, 31 bp, Artificial Sequence
  Synthetic Construct
cgcggatcccatatggacgagttgaccaacc

SEQ ID NO: 3529 - DNA, 26 bp, Artificial Sequence
  Synthetic Construct
cccgctcgaggttcagaaagcgggac

SEQ ID NO: 3530 - DNA, 32 bp, Artificial Sequence
  Synthetic Construct
aaagaattccttgcgattatcgtgcgcacgcg

SEQ ID NO: 3531 - DNA, 30 bp, Artificial Sequence
  Synthetic Construct
aaactgcagtcaaaatcccaaaacggggat

SEQ ID NO: 3532 - DNA, 33 bp, Artificial Sequence
  Synthetic Construct
cgcggatcccatatgtcgcaagaagccaaacag

SEQ ID NO: 3533 - DNA, 28 bp, Artificial Sequence
  Synthetic Construct
cccgctcgagtttggcggcatctttcat

SEQ ID NO: 3534 - DNA, 30 bp, Artificial Sequence
  Synthetic Construct
cgcggatcccatatgcaagaggttttgccc

SEQ ID NO: 3535 - DNA, 30 bp, Artificial Sequence
  Synthetic Construct
cccgctcgagacacaatatagcggatgaac

SEQ ID NO: 3536 - DNA, 30 bp, Artificial Sequence
  Synthetic Construct
cgcggatcccatatgcatccgggtgccgac

SEQ ID NO: 3537 - DNA, 27 bp, Artificial Sequence
  Synthetic Construct
cccgctcgagaagtttggcggcttcgg

SEQ ID NO: 3538 - DNA, 38 bp, Artificial Sequence
  Synthetic Construct
aaaaaagaattcatgtacgctaaaaaaggcggtttggg

SEQ ID NO: 3539 - DNA, 39 bp, Artificial Sequence
  Synthetic Construct
aaaaaactgcagtcaaggttttttcctgattgccgccgc

SEQ ID NO: 3540 - DNA, 38 bp, Artificial Sequence
  Synthetic Construct
aaaaaagaattcgccaaggctgccgatacacaaattga

SEQ ID NO: 3541 - DNA, 39 bp, Artificial Sequence
  Synthetic Construct
aaaaaactgcagttaaacattgtcgttgccgcccagatg

SEQ ID NO: 3542 - DNA, 30 bp, Artificial Sequence
  Synthetic Construct
cgcggatcccatatggcggacaaacccaag

SEQ ID NO: 3543 - DNA, 25 bp, Artificial Sequence
  Synthetic Construct
cccgctcgaggacggcattgagcag

SEQ ID NO: 3544 - DNA, 31 bp, Artificial Sequence
  Synthetic Construct
cgcggatcccatatggccgtttcactgaccg

SEQ ID NO: 3545 - DNA, 27 bp, Artificial Sequence
  Synthetic Construct
gcccaagcttacggttggattgccatg

SEQ ID NO: 3546 - DNA, 31 bp, Artificial Sequence
  Synthetic Construct
cgcggatcccatatggcctgccaagttcaaa

SEQ ID NO: 3547 - DNA, 25 bp, Artificial Sequence
  Synthetic Construct
cccgctcgagtttgggctgctcttc

SEQ ID NO: 3548 - DNA, 29 bp, Artificial Sequence
  Synthetic Construct
cgcggatcccatatggcgcgtttcgcctt

SEQ ID NO: 3549 - DNA, 26 bp, Artificial Sequence
  Synthetic Construct
cccgctcgagatgggtcgcgcgccgt

SEQ ID NO: 3550 - DNA, 32 bp, Artificial Sequence
  Synthetic Construct
cgcggatccgctagcaacggtttggatgcccg

SEQ ID NO: 3551 - DNA, 31 bp, Artificial Sequence
  Synthetic Construct
cccgctcgagtttgtctaagttcctgatatg

SEQ ID NO: 3552 - DNA, 36 bp, Artificial Sequence
  Synthetic Construct
ccggaattctacatatgctccaccataaaggtattg

SEQ ID NO: 3553 - DNA, 28 bp, Artificial Sequence
  Synthetic Construct
cccgctcgagtggtgaagagcggtttag

SEQ ID NO: 3554 - DNA, 31 bp, Artificial Sequence
  Synthetic Construct
cgcggatcccatatggacgttggacgatttc

SEQ ID NO: 3555 - DNA, 28 bp, Artificial Sequence
  Synthetic Construct
cccgctcgagaaacgccattacccgatg

SEQ ID NO: 3556 - DNA, 32 bp, Artificial Sequence
  Synthetic Construct
ccggaattctacatatgccaacacgtccaact

SEQ ID NO: 3557 - DNA, 30 bp, Artificial Sequence
  Synthetic Construct
cccgctcgaggaatgcgcctgtaattaatc

SEQ ID NO: 3558 - DNA, 31 bp, Artificial Sequence
  Synthetic Construct
cgcggatcccatatgatcggcaaacttgttg

SEQ ID NO: 3559 - DNA, 26 bp, Artificial Sequence
  Synthetic Construct
gcccaagcttaccgatacggtcgcag

SEQ ID NO: 3560 - DNA, 34 bp, Artificial Sequence
  Synthetic Construct
cgcggatcccatatgacgattttttcgatgctgc

SEQ ID NO: 3561 - DNA, 26 bp, Artificial Sequence
  Synthetic Construct
cccgctcgagcgacttggttaccgcg

SEQ ID NO: 3562 - DNA, 28 bp, Artificial Sequence
  Synthetic Construct
cgcggatcccatatgccgtctgaagccc

SEQ ID NO: 3563 - DNA, 29 bp, Artificial Sequence
  Synthetic Construct
cccgctcgagttttttcggtaggggattt

SEQ ID NO: 3564 - DNA, 29 bp, Artificial Sequence
  Synthetic Construct
cgcggatcccatatggacatcggcagtgc

SEQ ID NO: 3565 - DNA, 25 bp, Artificial Sequence
  Synthetic Construct
cccgctcgagcccgcgctgctggag

SEQ ID NO: 3566 - DNA, 30 bp, Artificial Sequence
  Synthetic Construct
cgcggatcccatatggtcggatcgagttac

SEQ ID NO: 3567 - DNA, 28 bp, Artificial Sequence
  Synthetic Construct
cccgctcgagaagtgttctgtttgcgca

SEQ ID NO: 3568 - DNA, 30 bp, Artificial Sequence
  Synthetic Construct
cgcggatcccatatgcgcaaacagaacact

SEQ ID NO: 3569 - DNA, 29 bp, Artificial Sequence
  Synthetic Construct
cccgctcgagctcatcattattgctaaca

SEQ ID NO: 3570 - DNA, 33 bp, Artificial Sequence
  Synthetic Construct
cgcggatcccatatgaagaataatgattgcttc

SEQ ID NO: 3571 - DNA, 25 bp, Artificial Sequence
  Synthetic Construct
cccgctcgagttcccgacctccgac

SEQ ID NO: 3572 - DNA, 29 bp, Artificial Sequence
  Synthetic Construct
cgcggatcccatatgcgtgctgcggtagt

SEQ ID NO: 3573 - DNA, 27 bp, Artificial Sequence
  Synthetic Construct
cccgctcgagtacgaaagccggtcgtg

SEQ ID NO: 3574 - DNA, 38 bp, Artificial Sequence
  Synthetic Construct
aaaaaagaattcatgattgacaggaaccgtatgctgcg

SEQ ID NO: 3575 - DNA, 39 bp, Artificial Sequence
  Synthetic Construct
aaaaaactgcagttattggtctttcaaacgcccttcctg

SEQ ID NO: 3576 - DNA, 41 bp, Artificial Sequence
  Synthetic Construct
aaaaaagaattcaaaatccttttgaaaacaagcgaaaacgg

SEQ ID NO: 3577 - DNA, 39 bp, Artificial Sequence; identical to SEQ ID NO: 3575
  Synthetic Construct

SEQ ID NO: 3578 - DNA, 38 bp, Artificial Sequence
  Synthetic Construct
aaaaaagaattcatgtatacaggcgaacgcttcaatac

SEQ ID NO: 3579 - DNA, 39 bp, Artificial Sequence
  Synthetic Construct
aaaaaatctagatcagattacgtaaccgtacacgctgac

SEQ ID NO: 3580 - DNA, 30 bp, Artificial Sequence
  Synthetic Construct
cgcggatcccatatggccgcgttgcgttac

SEQ ID NO: 3581 - DNA, 28 bp, Artificial Sequence
  Synthetic Construct
cccgctcgagatccgcaataccgaccag

SEQ ID NO: 3582 - DNA, 32 bp, Artificial Sequence
  Synthetic Construct
cgcggatccgctagcttttaacaccgccggac

SEQ ID NO: 3583 - DNA, 26 bp, Artificial Sequence
  Synthetic Construct
cccgctcgagacgcctgtttgtgcgg

SEQ ID NO: 3584 - DNA, 30 bp, Artificial Sequence
  Synthetic Construct
cgcggatcccatatggcggtttctttcctg

SEQ ID NO: 3585 - DNA, 26 bp, Artificial Sequence
  Synthetic Construct
cccgctcgaggcgcgtgaatatcgcg

SEQ ID NO: 3586 - DNA, 41 bp, Artificial Sequence
  Synthetic Construct
aaaaaagaattcgattatttctggtggattgttgcgttcag

SEQ ID NO: 3587 - DNA, 39 bp, Artificial Sequence
  Synthetic Construct
aaaaaactgcagctacgcataagtttttaccgtttttgg

SEQ ID NO: 3588 - DNA, 35 bp, Artificial Sequence
  Synthetic Construct
aaaaaagaattcgcgaaggcggtggcgcaaggcga

SEQ ID NO: 3589 - DNA, 39 bp, Artificial Sequence; identical to SEQ ID NO: 3587
  Synthetic Construct

SEQ ID NO: 3590 - DNA, 30 bp, Artificial Sequence
  Synthetic Construct
cgcggatcccatatggaagagctgcctccg

SEQ ID NO: 3591 - DNA, 26 bp, Artificial Sequence
  Synthetic Construct
cccgctcgagggcttttccggcgttt

SEQ ID NO: 3592 - DNA, 29 bp, Artificial Sequence
  Synthetic Construct
cgcggatcccatatgggtgcgggtatggt

SEQ ID NO: 3593 - DNA, 26 bp, Artificial Sequence
  Synthetic Construct
cccgctcgagaacagggcgacaccct

SEQ ID NO: 3594 - DNA, 35 bp, Artificial Sequence
  Synthetic Construct
aaaaaagaattccaagatacagctcgggcattcgc

SEQ ID NO: 3595 - DNA, 36 bp, Artificial Sequence
  Synthetic Construct
aaaaaactgcagtcaaaccaacaagccttggtcact

SEQ ID NO: 3596 - DNA, 30 bp, Artificial Sequence
  Synthetic Construct
cgcggatcccatatggcacgtttaaccgta

SEQ ID NO: 3597 - DNA, 27 bp, Artificial Sequence
  Synthetic Construct
cccgctcgagggcgtaagcctgcaatt

SEQ ID NO: 3598 - DNA, 36 bp, Artificial Sequence
  Synthetic Construct
aaaaaaggtaccgccgacgcagtggtcaaggcagaa

SEQ ID NO: 3599 - DNA, 33 bp, Artificial Sequence
  Synthetic Construct
aaactgcagtcagccggcggtcaataccgcccg

SEQ ID NO: 3600 - DNA, 36 bp, Artificial Sequence
  Synthetic Construct
aaaaaagaattcgcggaggtcaagagaaggtgtttg

SEQ ID NO: 3601 - DNA, 36 bp, Artificial Sequence
  Synthetic Construct
aaaaaactgcagttacgaatacgtcgtcaaaatggg

SEQ ID NO: 3602 - DNA, 33 bp, Artificial Sequence
  Synthetic Construct
aaagaattcctcatctttgccaacgcccccttc

SEQ ID NO: 3603 - DNA, 33 bp, Artificial Sequence
  Synthetic Construct
aaactgcagctattccctgttgcgcgtgtgcca

SEQ ID NO: 3604 - DNA, 32 bp, Artificial Sequence
  Synthetic Construct
aaagaattcttcttccgattcgatgttaatcg

SEQ ID NO: 3605 - DNA, 33 bp, Artificial Sequence
  Synthetic Construct
aaactgcagttagtaaaaacctttctgcttggc

SEQ ID NO: 3606 - DNA, 32 bp, Artificial Sequence
  Synthetic Construct
aaagaattctgcaaaccttgcgccacgtgccc

SEQ ID NO: 3607 - DNA, 36 bp, Artificial Sequence
  Synthetic Construct
aaactgcagttacgaagaccgcaacgaaaggcagag

SEQ ID NO: 3608 - DNA, 38 bp, Artificial Sequence
  Synthetic Construct
aaaaaagaattcgactttatccaaaacacggcttcgcc

SEQ ID NO: 3609 - DNA, 36 bp, Artificial Sequence; identical to SEQ ID NO: 3607
  Synthetic Construct

SEQ ID NO: 3610 - DNA, 35 bp, Artificial Sequence
  Synthetic Construct
aaagaattcgccgtcaagctcgttttgttgcaatg

SEQ ID NO: 3611 - DNA, 33 bp, Artificial Sequence
  Synthetic Construct
aaactgcagttattcggcggtaaatgccgtctg

SEQ ID NO: 3612 - DNA, 32 bp, Artificial Sequence
  Synthetic Construct
cgcggatcccatatgcctgtgtgcagctcgac

SEQ ID NO: 3613 - DNA, 26 bp, Artificial Sequence
  Synthetic Construct
cccgctcgagtcccagccccgtggag

SEQ ID NO: 3614 - DNA, 35 bp, Artificial Sequence
  Synthetic Construct
aaagaattcatgaccgcaaaggaagaactgttcgc

SEQ ID NO: 3615 - DNA, 33 bp, Artificial Sequence
  Synthetic Construct
aaactgcagtcagagcagttccaaatcggggct

SEQ ID NO: 3616 - DNA, 38 bp, Artificial Sequence
  Synthetic Construct
aaagaattcatgagtcttcaggcggtatttatataccc

SEQ ID NO: 3617 - DNA, 30 bp, Artificial Sequence
  Synthetic Construct
aaactgcagttacgcgtaagaaaaaactgc

SEQ ID NO: 3618 - DNA, 33 bp, Artificial Sequence
  Synthetic Construct
cgcggatcccatatgacagatttggttacggac

SEQ ID NO: 3619 - DNA, 31 bp, Artificial Sequence
  Synthetic Construct
cccgctcgagtttgctttcagtattattgaa

SEQ ID NO: 3620 - DNA, 44 bp, Artificial Sequence
  Synthetic Construct
aaaaaagaattcatgattttgccgtcgtccatcacgatgatgcg

SEQ ID NO: 3621 - DNA, 39 bp, Artificial Sequence
  Synthetic Construct
aaaaaactgcagctacaccaccatcggcgaatttatggc

SEQ ID NO: 3622 - DNA, 41 bp, Artificial Sequence
  Synthetic Construct
aaaaaagaattcatgccccgctttgaggacaagctcgtagg

SEQ ID NO: 3623 - DNA, 39 bp, Artificial Sequence
  Synthetic Construct
aaaaaactgcagtcataagccatgcttaccttccaacaa

SEQ ID NO: 3624 - DNA, 38 bp, Artificial Sequence
  Synthetic Construct
aaaaaagaattcggggcggcggctgggttggacgtagg

SEQ ID NO: 3625 - DNA, 39 bp, Artificial Sequence; identical to SEQ ID NO: 3623
  Synthetic Construct

SEQ ID NO: 3626 - DNA, 41 bp, Artificial Sequence
  Synthetic Construct
aaaaaaggtaccgtcaaagttgtattaatcgggcctttgcc

SEQ ID NO: 3627 - DNA, 36 bp, Artificial Sequence
  Synthetic Construct
aaaaaactgcagtcattcaaccatatcaaatctgcc

SEQ ID NO: 3628 - DNA, 38 bp, Artificial Sequence
  Synthetic Construct
aaaaaagaattcaaaactctcctaattcgtcatagtcg

SEQ ID NO: 3629 - DNA, 36 bp, Artificial Sequence; identical to SEQ ID NO: 3627
  Synthetic Construct

SEQ ID NO: 3630 - DNA, 33 bp, Artificial Sequence; identical to SEQ ID NO: 3022
  Synthetic Construct

SEQ ID NO: 3631 - DNA, 28 bp, Artificial Sequence
  Synthetic Construct
cccgctcgagtttagaagcgggcggcaa

SEQ ID NO: 3632 - DNA, 35 bp, Artificial Sequence
  Synthetic Construct
aaaaaaggtaccgcccccctgccggttgtaaccag

SEQ ID NO: 3633 - DNA, 39 bp, Artificial Sequence
  Synthetic Construct
aaaaaactgcagttattgcttcatcgcgttggtcaaggc

SEQ ID NO: 3634 - DNA, 41 bp, Artificial Sequence
  Synthetic Construct
aaaaaagaattcgcacccgtcggcgtattcctcgtcatgcg

SEQ ID NO: 3635 - DNA, 39 bp, Artificial Sequence
  Synthetic Construct
aaaaaatctagaggtcagaatgccgccttctttgccgag

SEQ ID NO: 3636 - DNA, 38 bp, Artificial Sequence
  Synthetic Construct
aaaaaagaattctcctaccacatcgaaattccttccgg

SEQ ID NO: 3637 - DNA, 39 bp, Artificial Sequence; identical to SEQ ID NO: 3635
  Synthetic Construct

SEQ ID NO: 3638 - DNA, 41 bp, Artificial Sequence
  Synthetic Construct
aaaaaagaattcctttaccttgacctgaccaacgggcacag

SEQ ID NO: 3639 - DNA, 39 bp, Artificial Sequence
  Synthetic Construct
aaaaaactgcagtcaacctgccagttgcgggaatatcgt

SEQ ID NO: 3640 - DNA, 33 bp, Artificial Sequence
  Synthetic Construct
cgcggatcccatatggccgtctttacttggaag

SEQ ID NO: 3641 - DNA, 29 bp, Artificial Sequence
  Synthetic Construct
cccgctcgagacggcagtatttgtttacg

SEQ ID NO: 3642 - DNA, 34 bp, Artificial Sequence
  Synthetic Construct
cgcggatcccatatgtttgcctgcaaaagaatcg

SEQ ID NO: 3643 - DNA, 28 bp, Artificial Sequence
  Synthetic Construct
cccgctcgagccgactttgcaaaaactg

SEQ ID NO: 3644 - DNA, 32 bp, Artificial Sequence
  Synthetic Construct
cgcggatcccatatggccgacctttccgaaaa

SEQ ID NO: 3645 - DNA, 26 bp, Artificial Sequence
  Synthetic Construct
cccgctcgaggaagcgcgttcccaag

SEQ ID NO: 3646 - DNA, 32 bp, Artificial Sequence; identical to SEQ ID NO: 3036
  Synthetic Construct

SEQ ID NO: 3647 - DNA, 28 bp, Artificial Sequence
  Synthetic Construct
cccgctcgagatcctgctcttttttgcc

SEQ ID NO: 3648 - DNA, 28 bp, Artificial Sequence
  Synthetic Construct
cgcggatcccatatgcacaccggacagg

SEQ ID NO: 3649 - DNA, 28 bp, Artificial Sequence
  Synthetic Construct
cccgctcgagcgtatcaaagacttgcgt

SEQ ID NO: 3650 - DNA, 30 bp, Artificial Sequence
  Synthetic Construct
cgcggatcccatatggcggtttggggcgga

SEQ ID NO: 3651 - DNA, 24 bp, Artificial Sequence
  Synthetic Construct
cccgctcgagtcggcgcggcgggc

SEQ ID NO: 3652 - DNA, 30 bp, Artificial Sequence
  Synthetic Construct
cgcggatcccatatgtgcgggcaaacgccc

SEQ ID NO: 3653 - DNA, 30 bp, Artificial Sequence
  Synthetic Construct
cccgctcgagttgatttttgcggatgattt

SEQ ID NO: 3654 - DNA, 38 bp, Artificial Sequence
  Synthetic Construct
aaaaaagaattcgtctggtcgattcgggttgtcagaac

SEQ ID NO: 3655 - DNA, 39 bp, Artificial Sequence
  Synthetic Construct
aaaaaactgcagttaccagctgatataaaacatcgcttt

SEQ ID NO: 3656 - DNA, 30 bp, Artificial Sequence
  Synthetic Construct
cgcggatcccatatgaaccggccggcctcc

SEQ ID NO: 3657 - DNA, 29 bp, Artificial Sequence
  Synthetic Construct
cccgctcgagcgatatttgattccgttgc

SEQ ID NO: 3658 - DNA, 35 bp, Artificial Sequence
  Synthetic Construct
aaaaaagaattcgcatacattgcttcgacagagag

SEQ ID NO: 3659 - DNA, 33 bp, Artificial Sequence
  Synthetic Construct
aaaaaactgcagtcaatccgattgcgacacggt

SEQ ID NO: 3660 - DNA, 41 bp, Artificial Sequence
  Synthetic Construct
aaaaaagaattcctgattgccgtgtggttcagccaaaaccc

SEQ ID NO: 3661 - DNA, 39 bp, Artificial Sequence
  Synthetic Construct
aaaaaactgcagtcatggctgtgtacttgatggttgcgt

SEQ ID NO: 3662 - DNA, 31 bp, Artificial Sequence
  Synthetic Construct
cgcggatccgctagcctacctgtcgcctccg

SEQ ID NO: 3663 - DNA, 27 bp, Artificial Sequence
  Synthetic Construct
cccgctcgagttgcctgattgcagcgg

SEQ ID NO: 3664 - DNA, 35 bp, Artificial Sequence
  Synthetic Construct
aaaaaagaattcatgagtcaaaccgatacgcaacg

SEQ ID NO: 3665 - DNA, 39 bp, Artificial Sequence
  Synthetic Construct
aaaaaactgcagttaaggtgcgggatagaatgtgggcgc

SEQ ID NO: 3666 - DNA, 39 bp, Artificial Sequence
  Synthetic Construct
aaaaaaggtaccgaatttttaccgatttccagcaccgga

SEQ ID NO: 3667 - DNA, 39 bp, Artificial Sequence
  Synthetic Construct
aaaaaactgcagtcattcccaacttatccagcctgacag

SEQ ID NO: 3668 - DNA, 38 bp, Artificial Sequence
  Synthetic Construct
aaaaaaggtacctcccgttcgggcagtacgattatggg

SEQ ID NO: 3669 - DNA, 39 bp, Artificial Sequence
  Synthetic Construct
aaaaaactgcagttacaaaccgacatcatgcagggtgaa

SEQ ID NO: 3670 - DNA, 34 bp, Artificial Sequence
  Synthetic Construct
cgcggatcccatatgtttatgaacaaattttccc

SEQ ID NO: 3671 - DNA, 24 bp, Artificial Sequence
  Synthetic Construct
cccgctcgagccgcatcggcagac

SEQ ID NO: 3672 - DNA, 34 bp, Artificial Sequence
  Synthetic Construct
cgcggatcccatatgttaaatcgggtattttatc

SEQ ID NO: 3673 - DNA, 26 bp, Artificial Sequence
  Synthetic Construct
cccgctcgagatccgccattccctgc

SEQ ID NO: 3674 - DNA, 36 bp, Artificial Sequence
  Synthetic Construct
aaaaaaggtaccatgttcagttttggctgggtgttt

SEQ ID NO: 3675 - DNA, 33 bp, Artificial Sequence
  Synthetic Construct
aaactgcagatgttcatattccctgccttcggc

SEQ ID NO: 3676 - DNA, 36 bp, Artificial Sequence
  Synthetic Construct
aaaaaaggtaccatgagtatcccatccggcgaaatt

SEQ ID NO: 3677 - DNA, 33 bp, Artificial Sequence
  Synthetic Construct
aaactgcagtcagtttttcatcgattgaaccgg

SEQ ID NO: 3678 - DNA, 38 bp, Artificial Sequence
  Synthetic Construct
aaaaaagaattcatggacgacccgcgcacctacggatc

SEQ ID NO: 3679 - DNA, 36 bp, Artificial Sequence
  Synthetic Construct
aaaaaactgcagtcagcggctgccgccgattttgct

SEQ ID NO: 3680 - DNA, 31 bp, Artificial Sequence
  Synthetic Construct
cgcggatcccatatgaaggcggcaacacagc

SEQ ID NO: 3681 - DNA, 29 bp, Artificial Sequence
  Synthetic Construct
cccgctcgagccttacgtttttcaaagcc

SEQ ID NO: 3682 - DNA, 41 bp, Artificial Sequence
  Synthetic Construct
aaaaaagaattcgtgcctcaggcattttcatttacccttgc

SEQ ID NO: 3683 - DNA, 39 bp, Artificial Sequence
  Synthetic Construct
aaaaaatctagattaaatccctctgccgtatttgtattc

SEQ ID NO: 3684 - DNA, 35 bp, Artificial Sequence
  Synthetic Construct
aaaaaagaattcaggctgattgaaaacaaacacgg

SEQ ID NO: 3685 - DNA, 39 bp, Artificial Sequence; identical to SEQ ID NO: 3683
  Synthetic Construct

SEQ ID NO: 3686 - DNA, 31 bp, Artificial Sequence; identical to SEQ ID NO: 3038
  Synthetic Construct

SEQ ID NO: 3687 - DNA, 28 bp, Artificial Sequence
  Synthetic Construct
cccgctcgagaggttgtccttgtctatg

SEQ ID NO: 3688 - DNA, 30 bp, Artificial Sequence
  Synthetic Construct
cgcggatcccatatggcaggcggagatggc

SEQ ID NO: 3689 - DNA, 26 bp, Artificial Sequence
  Synthetic Construct
cccgctcgagggtgtgatgttcaccc

SEQ ID NO: 3690 - DNA, 32 bp, Artificial Sequence
  Synthetic Construct
cgcggatcccatatggtagacgcgcttaagca

SEQ ID NO: 3691 - DNA, 25 bp, Artificial Sequence
  Synthetic Construct
cccgctcgagagctgcatggcggcg

SEQ ID NO: 3692 - DNA, 31 bp, Artificial Sequence
  Synthetic Construct
cgcggatcccatatgtgttcggggaaaggcg

SEQ ID NO: 3693 - DNA, 26 bp, Artificial Sequence
  Synthetic Construct
cccgctcgagccgcgcattcctcgca

SEQ ID NO: 3694 - DNA, 33 bp, Artificial Sequence
  Synthetic Construct
cgcggatcccatatgagcgatattgaagtgacg

SEQ ID NO: 3695 - DNA, 28 bp, Artificial Sequence
  Synthetic Construct
gcccaagctttgattcaagtccttgccg

SEQ ID NO: 3696 - DNA, 33 bp, Artificial Sequence
  Synthetic Construct
cgcggatcccatatgtttcgtttacaattcagg

SEQ ID NO: 3697 - DNA, 26 bp, Artificial Sequence
  Synthetic Construct
cccgctcgagcggcgttttatagcgg

SEQ ID NO: 3698 - DNA, 28 bp, Artificial Sequence
  Synthetic Construct
cgcggatcccatatgccttcgcggacac

SEQ ID NO: 3699 - DNA, 24 bp, Artificial Sequence
  Synthetic Construct
cccgctcgaggcgcactggcagcg

SEQ ID NO: 3700 - DNA, 32 bp, Artificial Sequence
  Synthetic Construct
cgcggatcccatatgggacatgaagtaacggt

SEQ ID NO: 3701 - DNA, 27 bp, Artificial Sequence
  Synthetic Construct
cccgctcgagaggaatagcctttgacg

SEQ ID NO: 3702 - DNA, 32 bp, Artificial Sequence
  Synthetic Construct
cgcggatcccatatggaggaaatagccttcga

SEQ ID NO: 3703 - DNA, 27 bp, Artificial Sequence
  Synthetic Construct
cccgctcgagaaatgccgcaaagcatc

SEQ ID NO: 3704 - DNA, 33 bp, Artificial Sequence
  Synthetic Construct
cgcggatcccatatgtgtacgttgatgttgtgg

SEQ ID NO: 3705 - DNA, 25 bp, Artificial Sequence
  Synthetic Construct
cccgctcgagtttgcgggcggcatc

SEQ ID NO: 3706 - DNA, 33 bp, Artificial Sequence
  Synthetic Construct
cgcggatcccatatgggtaaaggtgtggaaata

SEQ ID NO: 3707 - DNA, 24 bp, Artificial Sequence
  Synthetic Construct
cccgctcgaggtgcgcccagccgt

SEQ ID NO: 3708 - DNA, 35 bp, Artificial Sequence
  Synthetic Construct
aaagaattcgcttttttactgctccgaccggaagg

SEQ ID NO: 3709 - DNA, 30 bp, Artificial Sequence
  Synthetic Construct
aaactgcagtcaaatttcagactctgccac

SEQ ID NO: 3710 - DNA, 34 bp, Artificial Sequence; identical to SEQ ID NO: 3024
  Synthetic Construct

SEQ ID NO: 3711 - DNA, 27 bp, Artificial Sequence
  Synthetic Construct
cccgctcgagtttggcggttttgctgc

SEQ ID NO: 3712 - DNA, 30 bp, Artificial Sequence
  Synthetic Construct
cgcggatcccatatgcctgcgcttctttca

SEQ ID NO: 3713 - DNA, 30 bp, Artificial Sequence
  Synthetic Construct
cccgctcgagatatttacatttcagtcggc

SEQ ID NO: 3714 - DNA, 33 bp, Artificial Sequence
  Synthetic Construct
cgcggatcccatatggccaaaatctatacctgc

SEQ ID NO: 3715 - DNA, 26 bp, Artificial Sequence
  Synthetic Construct
cccgctcgagcatacgccccagttcc

SEQ ID NO: 3716 - DNA, 30 bp, Artificial Sequence
  Synthetic Construct
cgcggatcccatatgactgagccgaaacac

SEQ ID NO: 3717 - DNA, 29 bp, Artificial Sequence
  Synthetic Construct
gcccaagcttttctgatttcaaatcggca

SEQ ID NO: 3718 - DNA, 30 bp, Artificial Sequence
  Synthetic Construct
cgcggatcccatatggctctgctttccgcg

SEQ ID NO: 3719 - DNA, 31 bp, Artificial Sequence
  Synthetic Construct
cccgctcgagagggtgtgtgataataagaag

SEQ ID NO: 3720 - DNA, 33 bp, Artificial Sequence
  Synthetic Construct
cgcggatcccatatggccgaaatggttcaaatc

SEQ ID NO: 3721 - DNA, 28 bp, Artificial Sequence
  Synthetic Construct
cccgctcgaggcccgtgcatatcataaa

SEQ ID NO: 3722 - DNA, 32 bp, Artificial Sequence
  Synthetic Construct
aaagaattcttccctcaatgttgccgttttcg

SEQ ID NO: 3723 - DNA, 33 bp, Artificial Sequence
  Synthetic Construct
aaactgcagttatgctaaactcgaaacaaattc

SEQ ID NO: 3724 - DNA, 32 bp, Artificial Sequence
  Synthetic Construct
cgcggatccgctagctgctccggcagcaaaac

SEQ ID NO: 3725 - DNA, 28 bp, Artificial Sequence
  Synthetic Construct
gcccaagcttacgcagttcggaatggag

SEQ ID NO: 3726 - DNA, 28 bp, Artificial Sequence
  Synthetic Construct
cgcggatcccatatgagtgcgagcgcgg

SEQ ID NO: 3727 - DNA, 27 bp, Artificial Sequence
  Synthetic Construct
cccgctcgagacgaccgactgattccg

SEQ ID NO: 3728 - DNA, 38 bp, Artificial Sequence
  Synthetic Construct
aaaaaagaattctatgccgccgcctaccaaatctacgg

SEQ ID NO: 3729 - DNA, 39 bp, Artificial Sequence
  Synthetic Construct
aaaaaactgcagttaaaacagcgccgtgccgacgacaag

SEQ ID NO: 3730 - DNA, 38 bp, Artificial Sequence
  Synthetic Construct
aaaaaagaattcatgagcggtcagttgggcaaaggtgc

SEQ ID NO: 3731 - DNA, 39 bp, Artificial Sequence
  Synthetic Construct
aaaaaactgcagtcagtgttccaagtggtcggtatcaaa

SEQ ID NO: 3732 - DNA, 38 bp, Artificial Sequence
  Synthetic Construct
aaaaaagaattcttgggtgtcgcgtttgagccggaagt

SEQ ID NO: 3733 - DNA, 39 bp, Artificial Sequence; identical to SEQ ID NO: 3731
  Synthetic Construct

SEQ ID NO: 3734 - DNA, 31 bp, Artificial Sequence
  Synthetic Construct
aaagaattcatgccctttcccgttttcagac

SEQ ID NO: 3735 - DNA, 30 bp, Artificial Sequence
  Synthetic Construct
aaactgcagtcagacgaccccgccttcccc

SEQ ID NO: 3736 - DNA, 33 bp, Artificial Sequence
  Synthetic Construct
cgcggatcccatatgcatacccaaaaccaatcc

SEQ ID NO: 3737 - DNA, 29 bp, Artificial Sequence
  Synthetic Construct
cccgctcgagatcctgcaaataaagggtt

SEQ ID NO: 3738 - DNA, 32 bp, Artificial Sequence
  Synthetic Construct
cgcggatcccatatggtcgagctggtcaaagc

SEQ ID NO: 3739 - DNA, 28 bp, Artificial Sequence
  Synthetic Construct
cccgctcgagtggcatttcggtttcgtc

SEQ ID NO: 3740 - DNA, 31 bp, Artificial Sequence
  Synthetic Construct
cgcggatccgctagcgaggatttgcaggaaa

SEQ ID NO: 3741 - DNA, 28 bp, Artificial Sequence
  Synthetic Construct
cccgctcgagtaccaatgtcggcaaatc

SEQ ID NO: 3742 - DNA, 29 bp, Artificial Sequence
  Synthetic Construct
aaagaattcatgccgtctgaaaccgtgtc

SEQ ID NO: 3743 - DNA, 30 bp, Artificial Sequence
  Synthetic Construct
aaactgcagttaccgcgaaccggtcaggat

SEQ ID NO: 3744 - DNA, 38 bp, Artificial Sequence
  Synthetic Construct
aaaaaagaattcgccttcgatggcgacgttgtaggtac

SEQ ID NO: 3745 - DNA, 42 bp, Artificial Sequence
  Synthetic Construct
aaaaaatctagattaatgaagaagaacatattggaattttgg

SEQ ID NO: 3746 - DNA, 35 bp, Artificial Sequence
  Synthetic Construct
aaaaaagaattcggcaaaactcgtcatgaatttgc

SEQ ID NO: 3747 - DNA, 42 bp, Artificial Sequence; identical to SEQ ID NO: 3745
  Synthetic Construct

SEQ ID NO: 3748 - DNA, 41 bp, Artificial Sequence
  Synthetic Construct
aaagaattcgcgcccgccttctccctgcccgacctgcacgg

SEQ ID NO: 3749 - DNA, 33 bp, Artificial Sequence
  Synthetic Construct
aaactgcagctattgcgccacgcgcgtatcgat

SEQ ID NO: 3750 - DNA, 50 bp, Artificial Sequence
  Synthetic Construct
aaaaaagaattcgcaaatgactataaaaacaaaaacttccaagtacttgc

SEQ ID NO: 3751 - DNA, 33 bp, Artificial Sequence; identical to SEQ ID NO: 3749
  Synthetic Construct

SEQ ID NO: 3752 - DNA, 38 bp, Artificial Sequence
  Synthetic Construct
aaagaattcatgttcgtagataacggatttaataaaac

SEQ ID NO: 3753 - DNA, 33 bp, Artificial Sequence
  Synthetic Construct
aaactgcagttaacaacaaaaaacaaaccgctt

SEQ ID NO: 3754 - DNA, 38 bp, Artificial Sequence
  Synthetic Construct
aaagaattcgcctgcaaacctcaagacaacagtgcggc

SEQ ID NO: 3755 - DNA, 33 bp, Artificial Sequence
  Synthetic Construct
aaactgcagtcagagcagggtccttacatcggc

SEQ ID NO: 3756 - DNA, 47 bp, Artificial Sequence
  Synthetic Construct
aaaaaagtcgacatgataacggacaggtttcatctctttcattttcc

SEQ ID NO: 3757 - DNA, 33 bp, Artificial Sequence
  Synthetic Construct
aaactgcagttacgcaaacgctgcaaaatcccc

SEQ ID NO: 3758 - DNA, 41 bp, Artificial Sequence
  Synthetic Construct
aaaaaagaattcgtaaatcacgcctttggagtcgcaaacgg

SEQ ID NO: 3759 - DNA, 33 bp, Artificial Sequence; identical to SEQ ID NO: 3757
  Synthetic Construct

SEQ ID NO: 3760 - DNA, 32 bp, Artificial Sequence
  Synthetic Construct
aaaaaagaattcttggcgcgttggctggatac

SEQ ID NO: 3761 - DNA, 33 bp, Artificial Sequence
  Synthetic Construct
aaactgcagttatttctgatgccttttcccaac

SEQ ID NO: 3762 - DNA, 30 bp, Artificial Sequence
  Synthetic Construct
cgcggatcccatatgtcgcccgcgcccaac

SEQ ID NO: 3763 - DNA, 26 bp, Artificial Sequence
  Synthetic Construct
cccgctcgagctgccctgtcagacac

SEQ ID NO: 3764 - DNA, 35 bp, Artificial Sequence
  Synthetic Construct
aaagaattcgcgggcggttttgtttggacatcccg

SEQ ID NO: 3765 - DNA, 33 bp, Artificial Sequence
  Synthetic Construct
aaactgcagttaacggtgcggacgtttctgacc

SEQ ID NO: 3766 - DNA, 32 bp, Artificial Sequence
  Synthetic Construct
cgcggatcccatatgtgcggtttccacctgaa

SEQ ID NO: 3767 - DNA, 27 bp, Artificial Sequence
  Synthetic Construct
cccgctcgagttccgccttcagaaagg

SEQ ID NO: 3768 - DNA, 38 bp, Artificial Sequence
  Synthetic Construct
aaagaattcgagctttatatgtttcaacaggggacggc

SEQ ID NO: 3769 - DNA, 36 bp, Artificial Sequence
  Synthetic Construct
aaactgcagctaaacaatgccgtctgaaagtggaga

SEQ ID NO: 3770 - DNA, 41 bp, Artificial Sequence
  Synthetic Construct
aaaaaagaattcattagattctatcgccataaacagacggg

SEQ ID NO: 3771 - DNA, 39 bp, Artificial Sequence
  Synthetic Construct
aaaaaactgcagctaaacaatgccgtctgaaagtggaga

SEQ ID NO: 3772 - DNA, 44 bp, Artificial Sequence
  Synthetic Construct
aaaaaagaattctcgcctttccgggacggggcgcacaagatggc

SEQ ID NO: 3773 - DNA, 39 bp, Artificial Sequence
  Synthetic Construct
aaaaaactgcagtcatgcggtttcagacggcattttggc

SEQ ID NO: 3774 - DNA, 32 bp, Artificial Sequence
  Synthetic Construct
ccggaattctacatatgatactgccagcccgt

SEQ ID NO: 3775 - DNA, 30 bp, Artificial Sequence
  Synthetic Construct
cccgctcgagtttcaagctttcttcagatg

SEQ ID NO: 3776 - DNA, 29 bp, Artificial Sequence
  Synthetic Construct
cgcggatcccatatggcaagcccgtcgag

SEQ ID NO: 3777 - DNA, 28 bp, Artificial Sequence
  Synthetic Construct
cccgctcgagagaccaactccaactcgt

SEQ ID NO: 3778 - DNA, 33 bp, Artificial Sequence
  Synthetic Construct
cgcggatcccatatgaagtcgagcgcgaaatac

SEQ ID NO: 3779 - DNA, 26 bp, Artificial Sequence
  Synthetic Construct
cccgctcgagggcattgatcggcggc

SEQ ID NO: 3780 - DNA, 31 bp, Artificial Sequence
  Synthetic Construct
cgcggatcccatatggtcggtggcgaagagg

SEQ ID NO: 3781 - DNA, 26 bp, Artificial Sequence
  Synthetic Construct
cccgctcgagcgcatgggcgaagtca

SEQ ID NO: 3782 - DNA, 33 bp, Artificial Sequence
  Synthetic Construct
ccggaattctacatatgagtgcgaacatccttg

SEQ ID NO: 3783 - DNA, 27 bp, Artificial Sequence
  Synthetic Construct
cccgctcgagtttccccgacaccctcg

SEQ ID NO: 3784 - DNA, 29 bp, Artificial Sequence
  Synthetic Construct
cgcggatcccatatgctcagggtcagacc

SEQ ID NO: 3785 - DNA, 25 bp, Artificial Sequence
  Synthetic Construct
cccgctcgagcggcgcggcgttcag

SEQ ID NO: 3786 - DNA, 38 bp, Artificial Sequence
  Synthetic Construct
aaaaaagaattcctgattgccttgtgggaatatgcccg

SEQ ID NO: 3787 - DNA, 39 bp, Artificial Sequence
  Synthetic Construct
aaaaaactgcagttatgcatagacgctgataacggcaat

SEQ ID NO: 3788 - DNA, 34 bp, Artificial Sequence
  Synthetic Construct
cgcggatcccatatggacaccttccaaaaaatcg

SEQ ID NO: 3789 - DNA, 28 bp, Artificial Sequence
  Synthetic Construct
cccgctcgaggcgggcgttcatttcttt

SEQ ID NO: 3790 - DNA, 47 bp, Artificial Sequence
  Synthetic Construct
aaaaaagaattcatgggtattgccggcgccgtaaatgttttgaaccc

SEQ ID NO: 3791 - DNA, 39 bp, Artificial Sequence
  Synthetic Construct
aaaaaactgcagttatggccgacgcgcggctacctgacg

SEQ ID NO: 3792 - DNA, 33 bp, Artificial Sequence
  Synthetic Construct
cgcggatcccatatggcgcaaaaaggcaaaacc

SEQ ID NO: 3793 - DNA, 26 bp, Artificial Sequence
  Synthetic Construct
cccgctcgaggcgcagtgtgccgata

SEQ ID NO: 3794 - DNA, 29 bp, Artificial Sequence
  Synthetic Construct
cgcggatcccatatgccctgtttgtgccg

SEQ ID NO: 3795 - DNA, 27 bp, Artificial Sequence
  Synthetic Construct
cccgctcgaggacggtgtcatttcgcc

SEQ ID NO: 3796 - DNA, 30 bp, Artificial Sequence
  Synthetic Construct
cgcggatcccatatgtggtttgccgcccgc

SEQ ID NO: 3797 - DNA, 29 bp, Artificial Sequence
  Synthetic Construct
cccgctcgagaacttcgattttattcggg

SEQ ID NO: 3798 - DNA, 28 bp, Artificial Sequence
  Synthetic Construct
cgcggatcccatatggtttcgggcgagg

SEQ ID NO: 3799 - DNA, 28 bp, Artificial Sequence
  Synthetic Construct
cccgctcgagcattccgaatctgaacag

SEQ ID NO: 3800 - DNA, 30 bp, Artificial Sequence; identical to SEQ ID NO: 3026
  Synthetic Construct

SEQ ID NO: 3801 - DNA, 31 bp, Artificial Sequence
  Synthetic Construct
cccgctcgagatttacttttttgatgtcgac

SEQ ID NO: 3802 - DNA, 33 bp, Artificial Sequence
  Synthetic Construct
cgcggatcccatatggaaaggaacggtgtattt

SEQ ID NO: 3803 - DNA, 29 bp, Artificial Sequence
  Synthetic Construct
cccgctcgagaggctgtttggtagattcg

SEQ ID NO: 3804 - DNA, 30 bp, Artificial Sequence
  Synthetic Construct
cgcggatcccatatgagaaggttcgtacag

SEQ ID NO: 3805 - DNA, 25 bp, Artificial Sequence
  Synthetic Construct
cccgctcgaggccaacgcctccacg

SEQ ID NO: 3806 - DNA, 32 bp, Artificial Sequence
  Synthetic Construct
cgcggatcccatatgagattgggcgtttccac

SEQ ID NO: 3807 - DNA, 30 bp, Artificial Sequence
  Synthetic Construct
cccgctcgagagaattgatgatgtgtatgt

SEQ ID NO: 3808 - DNA, 31 bp, Artificial Sequence
  Synthetic Construct
cgcggatcccatatgaggcagacttcgccga

SEQ ID NO: 3809 - DNA, 26 bp, Artificial Sequence
  Synthetic Construct
cccgctcgagcacttcccccgaagtg

SEQ ID NO: 3810 - DNA, 28 bp, Artificial Sequence
  Synthetic Construct
cgcggatcccatatgcacttcgcccagc

SEQ ID NO: 3811 - DNA, 26 bp, Artificial Sequence
  Synthetic Construct
cccgctcgagcgccgtttggctttgg

SEQ ID NO: 3812 - DNA, 38 bp, Artificial Sequence
  Synthetic Construct
aaaaaagaattctttggagagaccgcgctgcaatgcgc

SEQ ID NO: 3813 - DNA, 36 bp, Artificial Sequence
  Synthetic Construct
aaaaaatctagatcagatgccgtcccagtcgttgaa

SEQ ID NO: 3814 - DNA, 38 bp, Artificial Sequence
  Synthetic Construct
aaaaaagaattcactgccggcaatcgactgcataatcg

SEQ ID NO: 3815 - DNA, 39 bp, Artificial Sequence
  Synthetic Construct
aaaaaactgcagttaacggaggtcaatatgatgaaattg

SEQ ID NO: 3816 - DNA, 42 bp, Artificial Sequence
  Synthetic Construct
aaaaaagaattcgcggctgaagcattgaattacaatattgtc

SEQ ID NO: 3817 - DNA, 39 bp, Artificial Sequence
  Synthetic Construct
aaaaaactgcagtcagaactgaaccgtcccattgacgct

SEQ ID NO: 3818 - DNA, 41 bp, Artificial Sequence
  Synthetic Construct
aaaaaaggtacctctttctggctggtgcagaacacccttgc

SEQ ID NO: 3819 - DNA, 39 bp, Artificial Sequence
  Synthetic Construct
aaaaaactgcagtcagttcgcacttttttctgttttgga

SEQ ID NO: 3820 - DNA, 28 bp, Artificial Sequence
  Synthetic Construct
cgcggatcccatatggcagcccatctcg

SEQ ID NO: 3821 - DNA, 29 bp, Artificial Sequence
  Synthetic Construct
cccgctcgagtttcagcgaatcaagtttc

SEQ ID NO: 3822 - DNA, 31 bp, Artificial Sequence
  Synthetic Construct
cgcggatcccatatggacctgcccttgacga

SEQ ID NO: 3823 - DNA, 28 bp, Artificial Sequence
  Synthetic Construct
cccgctcgagaaatgtatgctgtacgcc

SEQ ID NO: 3824 - DNA, 41 bp, Artificial Sequence
  Synthetic Construct
aaaaaagaattcgccgtcctgacttcctatcaagaaccagg

SEQ ID NO: 3825 - DNA, 39 bp, Artificial Sequence
  Synthetic Construct
aaaaaactgcagttatttgtttttgggcagtttcacttc

SEQ ID NO: 3826 - DNA, 44 bp, Artificial Sequence
  Synthetic Construct
aaaaaagaattcatgcaacaaaaaatccgtttccaaatcgaagg

SEQ ID NO: 3827 - DNA, 39 bp, Artificial Sequence
  Synthetic Construct
aaaaaactgcagctaatcgatttttacccgtttcaggcg

SEQ ID NO: 3828 - DNA, 41 bp, Artificial Sequence
  Synthetic Construct
aaaaaagaattcatgaaaaaacctttgatttcagttgcggc

SEQ ID NO: 3829 - DNA, 36 bp, Artificial Sequence
  Synthetic Construct
aaaaaactgcagttactgctgcggctctgaaaccat

SEQ ID NO: 3830 - DNA, 38 bp, Artificial Sequence
  Synthetic Construct
aaaaaagaattccactacatcgttgccagattgtgcgg

SEQ ID NO: 3831 - DNA, 39 bp, Artificial Sequence
  Synthetic Construct
aaaaaactgcagctaaccgagcagccgggtaacgtcgtt

SEQ ID NO: 3832 - DNA, 41 bp, Artificial Sequence
  Synthetic Construct
aaaaaagaattccgcgattacaccgccaagctgaaaatggg

SEQ ID NO: 3833 - DNA, 36 bp, Artificial Sequence
  Synthetic Construct
aaaaaactgcagttaccaaacgtcggatttgatacg

SEQ ID NO: 3834 - DNA, 33 bp, Artificial Sequence
  Synthetic Construct
cgcggatccgctagccttgaactgaacggactc

SEQ ID NO: 3835 - DNA, 26 bp, Artificial Sequence
  Synthetic Construct
cccgctcgaggcggaagcggacgatt

SEQ ID NO: 3836 - DNA, 38 bp, Artificial Sequence
  Synthetic Construct
aaaaaagaattcggtaagttcgccgttcaggcctttca

SEQ ID NO: 3837 - DNA, 39 bp, Artificial Sequence
  Synthetic Construct
aaaaaactgcagttacgccgccgtttcctgacactcgcg

SEQ ID NO: 3838 - DNA, 38 bp, Artificial Sequence
  Synthetic Construct
aaaaaagaattctgccagccgccggaggcggagaaagc

SEQ ID NO: 3839 - DNA, 36 bp, Artificial Sequence
  Synthetic Construct
aaaaaactgcagttatttcaagccgagtatgccgcg

SEQ ID NO: 3840 - DNA, 30 bp, Artificial Sequence
  Synthetic Construct
cgcggatcccatatgtcccaacaatacgtc

SEQ ID NO: 3841 - DNA, 27 bp, Artificial Sequence
  Synthetic Construct
cccgctcgagacgcgttaccggtttgt

SEQ ID NO: 3842 - DNA, 30 bp, Artificial Sequence
  Synthetic Construct
cgcggatcccatatgctgcttcatgtcagc

SEQ ID NO: 3843 - DNA, 27 bp, Artificial Sequence
  Synthetic Construct
gcccaagcttacgtatccagctcgaag

SEQ ID NO: 3844 - DNA, 35 bp, Artificial Sequence
  Synthetic Construct
cgcggatcccatatgatatgttcccaaccggcaat

SEQ ID NO: 3845 - DNA, 28 bp, Artificial Sequence
  Synthetic Construct
cccgctcgagaaaacaatcctcaggcac

SEQ ID NO: 3846 - DNA, 30 bp, Artificial Sequence
  Synthetic Construct
cgcggatccgctagcttgctccatcaatgc

SEQ ID NO: 3847 - DNA, 28 bp, Artificial Sequence
  Synthetic Construct
cccgctcgagatgcagctgctaaaagcg

SEQ ID NO: 3848 - DNA, 38 bp, Artificial Sequence
  Synthetic Construct
aaaaaagaattcctgtcctcgcgtaggcggggacgggg

SEQ ID NO: 3849 - DNA, 36 bp, Artificial Sequence
  Synthetic Construct
aaaaaactgcagctacaagatgccggcaagttcggc

SEQ ID NO: 3850 - DNA, 29 bp, Artificial Sequence
  Synthetic Construct
cgcggatccgctagccccgaagcgcactt

SEQ ID NO: 3851 - DNA, 26 bp, Artificial Sequence
  Synthetic Construct
cccgctcgaggacggcatctgcacgg

SEQ ID NO: 3852 - DNA, 38 bp, Artificial Sequence
  Synthetic Construct
aaaaaagaattccgcgaataccgcgccgatgcgggcgc

SEQ ID NO: 3853 - DNA, 39 bp, Artificial Sequence
  Synthetic Construct
aaaaaactgcagttaaagcgatttgaggcgggcgatacg

SEQ ID NO: 3854 - DNA, 38 bp, Artificial Sequence
  Synthetic Construct
aaaaaagaattcatgctgctcgacctcaaccgcttttc

SEQ ID NO: 3855 - DNA, 36 bp, Artificial Sequence
  Synthetic Construct
aaaaaactgcagtcagacggccttatgcgatctgac

SEQ ID NO: 3856 - DNA, 41 bp, Artificial Sequence
  Synthetic Construct
aaaaaagaattcatgtccgccctcctccccatcatcaaccg

SEQ ID NO: 3857 - DNA, 36 bp, Artificial Sequence
  Synthetic Construct
aaaaaactgcagttagtctatccaaatgtcgcgttc

SEQ ID NO: 3858 - DNA, 31 bp, Artificial Sequence
  Synthetic Construct
cgcggatcccatatggttgtggatagactcg

SEQ ID NO: 3859 - DNA, 29 bp, Artificial Sequence
  Synthetic Construct
cccgctcgagctggattatgatgtctgtc

SEQ ID NO: 3860 - DNA, 32 bp, Artificial Sequence
  Synthetic Construct
cgcggatcccatatgattggagggcttatgca

SEQ ID NO: 3861 - DNA, 29 bp, Artificial Sequence
  Synthetic Construct
cccgctcgagacgcttcaacatctttgcc

SEQ ID NO: 3862 - DNA, 30 bp, Artificial Sequence
  Synthetic Construct
cgcggatcccatatgccgtctcaaaacggg

SEQ ID NO: 3863 - DNA, 29 bp, Artificial Sequence
  Synthetic Construct
cccgctcgagaacgactttgaacgcgcaa

SEQ ID NO: 3864 - DNA, 29 bp, Artificial Sequence
  Synthetic Construct
cgcggatcccatatgtcgcgttcgagccg

SEQ ID NO: 3865 - DNA, 29 bp, Artificial Sequence
  Synthetic Construct
cccgctcgagagcctgtaaaataagcggc

SEQ ID NO: 3866 - DNA, 30 bp, Artificial Sequence
  Synthetic Construct
cgcggatcccatatgtccgtcgtgagcggc

SEQ ID NO: 3867 - DNA, 26 bp, Artificial Sequence
  Synthetic Construct
cccgctcgagccatactgcggcgttc

SEQ ID NO: 3868 - DNA, 41 bp, Artificial Sequence
  Synthetic Construct
aaaaaagaattcatgtcaaacacaatcaaaatggttgtcgg

SEQ ID NO: 3869 - DNA, 36 bp, Artificial Sequence
  Synthetic Construct
aaaaaatctagattagtccgggcggcaggcagctcg

SEQ ID NO: 3870 - DNA, 35 bp, Artificial Sequence
  Synthetic Construct
aaaaaagaattcgggcttctcgccgcctcgcttgc

SEQ ID NO: 3871 - DNA, 39 bp, Artificial Sequence
  Synthetic Construct
aaaaaactgcagtcattttttgtgttttaaaacgagata

SEQ ID NO: 3872 - DNA, 31 bp, Artificial Sequence
  Synthetic Construct
cgcggatcccatatggccgccctgcctaaag

SEQ ID NO: 3873 - DNA, 31 bp, Artificial Sequence
  Synthetic Construct
cccgctcgagtttgtccaaatgataaatctg

SEQ ID NO: 3874 - DNA, 32 bp, Artificial Sequence
  Synthetic Construct
cgcggatcccatatgtccccgcgcttttaccg

SEQ ID NO: 3875 - DNA, 26 bp, Artificial Sequence
  Synthetic Construct
cccgctcgagagattcgggcctgcgc

SEQ ID NO: 3876 - DNA, 33 bp, Artificial Sequence
  Synthetic Construct
cgcggatcccatatgtttgcaaccaggaaaatg

SEQ ID NO: 3877 - DNA, 28 bp, Artificial Sequence
  Synthetic Construct
cccgctcgagcggcaaaattaccgcctt

SEQ ID NO: 3878 - DNA, 38 bp, Artificial Sequence
  Synthetic Construct
aaaaaagaattcaaagcaggcgaggcaggcgcgctggg

SEQ ID NO: 3879 - DNA, 45 bp, Artificial Sequence
  Synthetic Construct
aaaaaactgcagttacgaatgaaacagggtacccgtcatcaaggc

SEQ ID NO: 3880 - DNA, 38 bp, Artificial Sequence
  Synthetic Construct
aaaaaaggtaccgccttacaaacatggattttgcgttc

SEQ ID NO: 3881 - DNA, 36 bp, Artificial Sequence
  Synthetic Construct
aaaaaactgcagctacgcacctgaagcgctggcaaa

SEQ ID NO: 3882 - DNA, 38 bp, Artificial Sequence
  Synthetic Construct
aaaaaagaattcgccacctttatcgcgtatgaaaacga

SEQ ID NO: 3883 - DNA, 39 bp, Artificial Sequence
  Synthetic Construct
aaaaaactgcagttacaacaccgccgtccggttcaaacc

SEQ ID NO: 3884 - DNA, 35 bp, Artificial Sequence
  Synthetic Construct
aaaaaagaattcgcggctttgggtatttctttcgg

SEQ ID NO: 3885 - DNA, 39 bp, Artificial Sequence
  Synthetic Construct
aaaaaactgcagttaggagacttcgccaatggagccggg

SEQ ID NO: 3886 - DNA, 44 bp, Artificial Sequence
  Synthetic Construct
aaaaaagaattcatgacccagcgacgggtcggcaagcaaaaccg

SEQ ID NO: 3887 - DNA, 36 bp, Artificial Sequence
  Synthetic Construct
aaaaaactgcagttaatccactataatcctgttgct

SEQ ID NO: 3888 - DNA, 41 bp, Artificial Sequence
  Synthetic Construct
aaaaaagaattcatgattggcgaaaagtttatcgtagttgg

SEQ ID NO: 3889 - DNA, 36 bp, Artificial Sequence
  Synthetic Construct
aaaaaactgcagtcacgaaccgattatgctgatcgg

SEQ ID NO: 3890 - DNA, 32 bp, Artificial Sequence
  Synthetic Construct
cgcggatcccatatgatgctttattttgttcg

SEQ ID NO: 3891 - DNA, 25 bp, Artificial Sequence
  Synthetic Construct
cccgctcgagatcgcggctgccgac

SEQ ID NO: 3892 - DNA, 31 bp, Artificial Sequence
  Synthetic Construct
cgcggatcccatatgcggtatccgccgcaat

SEQ ID NO: 3893 - DNA, 27 bp, Artificial Sequence
  Synthetic Construct
cccgctcgagaggattgcggggcatta

SEQ ID NO: 3894 - DNA, 31 bp, Artificial Sequence
  Synthetic Construct
cgcggatcccatatggcttcgccgtcggcag

SEQ ID NO: 3895 - DNA, 28 bp, Artificial Sequence
  Synthetic Construct
cccgctcgagaaccgaaaaacagaccgc

SEQ ID NO: 3896 - DNA, 44 bp, Artificial Sequence
  Synthetic Construct
aaaaaagaattcatgccgtctgaaaggtcggcggattgttgccc

SEQ ID NO: 3897 - DNA, 39 bp, Artificial Sequence
  Synthetic Construct
aaaaaatctagactacccgcaatatcggcagtccaatat

SEQ ID NO: 3898 - DNA, 38 bp, Artificial Sequence
  Synthetic Construct
aaaaaagaattcgtggaacagagcaacacgttaaatcg

SEQ ID NO: 3899 - DNA, 39 bp, Artificial Sequence
  Synthetic Construct
aaaaaactgcagctacgaggaaaccgaagaccaggccgc

SEQ ID NO: 3900 - DNA, 35 bp, Artificial Sequence
  Synthetic Construct
aaaaaagaattcatgcaaaggctcgccgcagacgg

SEQ ID NO: 3901 - DNA, 39 bp, Artificial Sequence
  Synthetic Construct
aaaaaactgcagttagattatcagggatatccggtagaa

SEQ ID NO: 3902 - DNA, 41 bp, Artificial Sequence
  Synthetic Construct
aaaaaagaattcatgaacaggcgcgacgcgcggatcgaacg

SEQ ID NO: 3903 - DNA, 39 bp, Artificial Sequence
  Synthetic Construct
aaaaaactgcagtcaagctgtgtgctgattgaatgcgac

SEQ ID NO: 3904 - DNA, 35 bp, Artificial Sequence
  Synthetic Construct
aaaaaagaattcggtacgtcagaacccgcccaccg

SEQ ID NO: 3905 - DNA, 36 bp, Artificial Sequence
  Synthetic Construct
aaaaaactgcagttaacggcggaaactgccgccgtc

SEQ ID NO: 3906 - DNA, 35 bp, Artificial Sequence
  Synthetic Construct
aaaaaagaattcatgtccaaactcaaaaccatcgc

SEQ ID NO: 3907 - DNA, 36 bp, Artificial Sequence
  Synthetic Construct
aaaaaactgcagtcagacggcatggcggtctgtttt

SEQ ID NO: 3908 - DNA, 44 bp, Artificial Sequence
  Synthetic Construct
aaaaaaggtaccgctgccgaagactcaggcctgccgctttaccg

SEQ ID NO: 3909 - DNA, 39 bp, Artificial Sequence
  Synthetic Construct
aaaaaactgcagttatttgcccagttggtagaatgcggc

SEQ ID NO: 3910 - DNA, 38 bp, Artificial Sequence
  Synthetic Construct
aaaaaagaattcgcggctttgccggtaattttcatcgg

SEQ ID NO: 3911 - DNA, 39 bp, Artificial Sequence
  Synthetic Construct
aaaaaactgcagctatgccggtctggttgccggcggcga

SEQ ID NO: 3912 - DNA, 38 bp, Artificial Sequence
  Synthetic Construct
aaaaaagaattccggccgacgtcgttgcgtcctaagtc

SEQ ID NO: 3913 - DNA, 39 bp, Artificial Sequence
  Synthetic Construct
aaaaaactgcagctacgatttcggcgatttccacatcgt

SEQ ID NO: 3914 - DNA, 41 bp, Artificial Sequence
  Synthetic Construct
aaaaaagaattcgcagaatttgccgaccgccatttgtgcgc

SEQ ID NO: 3915 - DNA, 39 bp, Artificial Sequence
  Synthetic Construct
aaaaaactgcagttatagggactgatgcagtttttttgc

SEQ ID NO: 3916 - DNA, 30 bp, Artificial Sequence
  Synthetic Construct
cgcggatcccatatggtgtccggaattgtg

SEQ ID NO: 3917 - DNA, 28 bp, Artificial Sequence
  Synthetic Construct
cccgctcgagggcagaatgtttaccgtt

SEQ ID NO: 3918 - DNA, 44 bp, Artificial Sequence
  Synthetic Construct
aaaaaagaattcatgcacatcggcggctattttatcgacaaccc

SEQ ID NO: 3919 - DNA, 39 bp, Artificial Sequence
  Synthetic Construct
aaaaaactgcagtcacgacgtgtctgttcgccgtcgggc

SEQ ID NO: 3920 - DNA, 32 bp, Artificial Sequence
  Synthetic Construct
cgcggatcccatatgtgtatcgagatgaaatt

SEQ ID NO: 3921 - DNA, 27 bp, Artificial Sequence
  Synthetic Construct
cccgctcgaggtaaaaatcggggctgc

SEQ ID NO: 3922 - DNA, 29 bp, Artificial Sequence
  Synthetic Construct
cgcggatcccatatggcggctggcgcggt

SEQ ID NO: 3923 - DNA, 29 bp, Artificial Sequence
  Synthetic Construct
cccgctcgagaaatcgagttttacaccac

SEQ ID NO: 3924 - DNA, 38 bp, Artificial Sequence
  Synthetic Construct
aaaaaagaattcatgaaatgggacgaaacgcgcttcgg

SEQ ID NO: 3925 - DNA, 39 bp, Artificial Sequence
  Synthetic Construct
aaaaaactgcagtcaatccaaaattttgccgacgatttc

SEQ ID NO: 3926 - DNA, 38 bp, Artificial Sequence; identical to SEQ ID NO: 3460
  Synthetic Construct

SEQ ID NO: 3927 - DNA, 36 bp, Artificial Sequence; identical to SEQ ID NO: 3461
  Synthetic Construct

SEQ ID NO: 3928 - DNA, 47 bp, Artificial Sequence
  Synthetic Construct
aaaaaagaattcccgcatccgtttgatttccatttcgtattcgtccg

SEQ ID NO: 3929 - DNA, 36 bp, Artificial Sequence
  Synthetic Construct
aaaaaactgcagttaatgacacaataggcgcaagtc

SEQ ID NO: 3930 - DNA, 41 bp, Artificial Sequence
  Synthetic Construct
aaaaaagaattcatgcgccgcatcattaaaaaacaccagcc

SEQ ID NO: 3931 - DNA, 36 bp, Artificial Sequence
  Synthetic Construct
aaaaaactgcagttacagtatccgtttgatgtcggc

SEQ ID NO: 3932 - DNA, 38 bp, Artificial Sequence
  Synthetic Construct
aaaaaagaattcaaaaacgcttcgggcgtttcgtcttc

SEQ ID NO: 3933 - DNA, 42 bp, Artificial Sequence
  Synthetic Construct
aaaaaactgcagttaggagcttttggaacgcgtcggactggc

SEQ ID NO: 3934 - DNA, 29 bp, Artificial Sequence
  Synthetic Construct
cgcggatcccatatgaccagcagggtaac

SEQ ID NO: 3935 - DNA, 30 bp, Artificial Sequence
  Synthetic Construct
cccgctcgagagcaactataaaaacgcaag

SEQ ID NO: 3936 - DNA, 30 bp, Artificial Sequence
  Synthetic Construct
cgcggatcccatatgaggaaaatccgcacc

SEQ ID NO: 3937 - DNA, 26 bp, Artificial Sequence
  Synthetic Construct
cccgctcgagacgggataggcggttg

SEQ ID NO: 3938 - DNA, 38 bp, Artificial Sequence
  Synthetic Construct
aaaaaagaattcatggatattgaaaccttccttgcagg

SEQ ID NO: 3939 - DNA, 36 bp, Artificial Sequence
  Synthetic Construct
aaaaaactgcagctacaaacccagctcgcgcaggaa

SEQ ID NO: 3940 - DNA, 38 bp, Artificial Sequence
  Synthetic Construct
aaaaaagaattcatgaaaacagcccgccgccgttcccg

SEQ ID NO: 3941 - DNA, 36 bp, Artificial Sequence
  Synthetic Construct
aaaaaactgcagtcaacggcgtttgggctcgtcggg

SEQ ID NO: 3942 - DNA, 29 bp, Artificial Sequence
  Synthetic Construct
cgcggatcccatatgaacaccatcgcccc

SEQ ID NO: 3943 - DNA, 29 bp, Artificial Sequence
  Synthetic Construct
cccgctcgagttcttcgtcttcaaactgt

SEQ ID NO: 3944 - DNA, 41 bp, Artificial Sequence
  Synthetic Construct
aaaaaagaattcagacggcattcccgatcagtcgattttga

SEQ ID NO: 3945 - DNA, 39 bp, Artificial Sequence
  Synthetic Construct
aaaaaactgcagttacgtatgcgcgaaatcgaccgccgc

SEQ ID NO: 3946 - DNA, 31 bp, Artificial Sequence
  Synthetic Construct
cgcggatccgctagcacgaagggcagttcgg

SEQ ID NO: 3947 - DNA, 27 bp, Artificial Sequence
  Synthetic Construct
cccgctcgagcatcaaaaacctgccgc

SEQ ID NO: 3948 - DNA, 38 bp, Artificial Sequence
  Synthetic Construct
aaaaaagaattcatgacgacgccgatggcaatcagtgc

SEQ ID NO: 3949 - DNA, 36 bp, Artificial Sequence
  Synthetic Construct
aaaaaactgcagttaccgtcttccgcaaaaaacagc

SEQ ID NO: 3950 - DNA, 32 bp, Artificial Sequence
  Synthetic Construct
cgcggatcccatatgtgcagcacaccggacaa

SEQ ID NO: 3951 - DNA, 29 bp, Artificial Sequence
  Synthetic Construct
cccgctcgaggagtttttttccgcatacg

SEQ ID NO: 3952 - DNA, 32 bp, Artificial Sequence
  Synthetic Construct
cgcggatcccatatgtgcggtactgtgcaaag

SEQ ID NO: 3953 - DNA, 27 bp, Artificial Sequence
  Synthetic Construct
cccgctcgagctcgaccatctgttgcg

SEQ ID NO: 3954 - DNA, 37 bp, Artificial Sequence
  Synthetic Construct
cgcggatcccatatgtgtttgcttaataataaacatt

SEQ ID NO: 3955 - DNA, 26 bp, Artificial Sequence
  Synthetic Construct
cccgctcgagctttttccccgccgca

SEQ ID NO: 3956 - DNA, 31 bp, Artificial Sequence
  Synthetic Construct
cgcggatcccatatgtgcggcggttcggaag

SEQ ID NO: 3957 - DNA, 29 bp, Artificial Sequence
  Synthetic Construct
cccgctcgagcattccgattctgatgaag

SEQ ID NO: 3958 - DNA, 32 bp, Artificial Sequence
  Synthetic Construct
cgcggatcccatatgtgcgacagcaaagtcca

SEQ ID NO: 3959 - DNA, 27 bp, Artificial Sequence
  Synthetic Construct
cccgctcgagctgcgcggctttttgtt

SEQ ID NO: 3960 - DNA, 33 bp, Artificial Sequence
  Synthetic Construct
cgcggatcccatatgtgttctccgagcaaagac

SEQ ID NO: 3961 - DNA, 28 bp, Artificial Sequence
  Synthetic Construct
cccgctcgagtattcgccccgtgtttgg

SEQ ID NO: 3962 - DNA, 32 bp, Artificial Sequence
  Synthetic Construct
cgcggatcccatatggccacggcttatatccc

SEQ ID NO: 3963 - DNA, 28 bp, Artificial Sequence
  Synthetic Construct
cccgctcgagtttgaggcaggaagaaag

SEQ ID NO: 3964 - DNA, 32 bp, Artificial Sequence
  Synthetic Construct
cgcggatcccatatgttggtttccgcatccgg

SEQ ID NO: 3965 - DNA, 26 bp, Artificial Sequence
  Synthetic Construct
cccgctcgagtctgcgtcggtgcggt

SEQ ID NO: 3966 - DNA, 33 bp, Artificial Sequence
  Synthetic Construct
cgcggatcccatatgttgcctcaaactcgtccg

SEQ ID NO: 3967 - DNA, 26 bp, Artificial Sequence
  Synthetic Construct
cccgctcgagtcgtttgcgcacggct

SEQ ID NO: 3968 - DNA, 31 bp, Artificial Sequence
  Synthetic Construct
cgcggatcccatatgttgggttgccggcagg

SEQ ID NO: 3969 - DNA, 28 bp, Artificial Sequence
  Synthetic Construct
cccgctcgagttgattgccgcaatgatg

SEQ ID NO: 3970 - DNA, 38 bp, Artificial Sequence
  Synthetic Construct
aaaaaagaattcgcatcgacagacggtgtgtcgtggac

SEQ ID NO: 3971 - DNA, 39 bp, Artificial Sequence
  Synthetic Construct
aaaaaactgcagttacgctaccggcacgacttccaaacc

SEQ ID NO: 3972 - DNA, 35 bp, Artificial Sequence
  Synthetic Construct
cgcggatcccatatgaagacttgtttggatacttc

SEQ ID NO: 3973 - DNA, 26 bp, Artificial Sequence
  Synthetic Construct
cccgctcgagtgccgacaacagcctc

SEQ ID NO: 3974 - DNA, 41 bp, Artificial Sequence
  Synthetic Construct
aaaaaagaattcatgccgtgttccaaagccagttggatttc

SEQ ID NO: 3975 - DNA, 39 bp, Artificial Sequence
  Synthetic Construct
aaaaaactgcagttaaccccattccacccggagaaccga

SEQ ID NO: 3976 - DNA, 31 bp, Artificial Sequence
  Synthetic Construct
cgcggatccgctagccaaacgctggcaaccg

SEQ ID NO: 3977 - DNA, 30 bp, Artificial Sequence
  Synthetic Construct
cccgctcgagttttgcaggtttgatgtttg

SEQ ID NO: 3978 - DNA, 35 bp, Artificial Sequence
  Synthetic Construct
aaaaaagaattcgcttctaccggtacgctggcgcg

SEQ ID NO: 3979 - DNA, 42 bp, Artificial Sequence
  Synthetic Construct
aaaaaactgcagttagttttgccggataatatggcgggtgcg

SEQ ID NO: 3980 - DNA, 35 bp, Artificial Sequence
  Synthetic Construct
cgcggatccgctagcgaaattattaacgatgcaga

SEQ ID NO: 3981 - DNA, 30 bp, Artificial Sequence
  Synthetic Construct
cccgctcgaggaaactgtaattcaagttga

SEQ ID NO: 3982 - DNA, 34 bp, Artificial Sequence
  Synthetic Construct
cgcggatccgctagcccttttaagccatccaaaa

SEQ ID NO: 3983 - DNA, 26 bp, Artificial Sequence
  Synthetic Construct
cccgctcgagttgaccggtgaggacg

SEQ ID NO: 3984 - DNA, 33 bp, Artificial Sequence
  Synthetic Construct
cgcggatcccatatggaaacccacgaaaaaatc

SEQ ID NO: 3985 - DNA, 25 bp, Artificial Sequence
  Synthetic Construct
cccgctcgagaacggtttcggtcag

SEQ ID NO: 3986 - DNA, 32 bp, Artificial Sequence
  Synthetic Construct
cgcggatcccatatgagctatcaagacatctt

SEQ ID NO: 3987 - DNA, 28 bp, Artificial Sequence
  Synthetic Construct
cccgctcgaggcggtaggtaaatcggat

SEQ ID NO: 3988 - DNA, 32 bp, Artificial Sequence
  Synthetic Construct
cgcggatcccatatggccaacaaaccggcaag

SEQ ID NO: 3989 - DNA, 28 bp, Artificial Sequence
  Synthetic Construct
cccgctcgagtttagaaccgcatttgcc

SEQ ID NO: 3990 - DNA, 32 bp, Artificial Sequence
  Synthetic Construct
cgcggatcccatatggagccgataatggcaaa

SEQ ID NO: 3991 - DNA, 31 bp, Artificial Sequence
  Synthetic Construct
cccgctcgagggcgcgggcatggtcttgtcc

SEQ ID NO: 3992 - DNA, 30 bp, Artificial Sequence
  Synthetic Construct
cgcggatcccatatgagcggatggcatacc

SEQ ID NO: 3993 - DNA, 30 bp, Artificial Sequence
  Synthetic Construct
cccgctcgagttttgcatagctgttgacca

SEQ ID NO: 3994 - DNA, 28 bp, Artificial Sequence
  Synthetic Construct
cgcggatcccatatgcgacccaagcccc

SEQ ID NO: 3995 - DNA, 27 bp, Artificial Sequence
  Synthetic Construct
cccgctcgagaatgcgaatccgccgcc

SEQ ID NO: 3996 - DNA, 30 bp, Artificial Sequence
  Synthetic Construct
cgcggatcccatatggtgcgcacggttaaa

SEQ ID NO: 3997 - DNA, 30 bp, Artificial Sequence
  Synthetic Construct
cccgctcgagttgcttatccttaagggtta

SEQ ID NO: 3998 - DNA, 33 bp, Artificial Sequence
  Synthetic Construct
cgcggatcccatatgaccatctatttcaaaaac

SEQ ID NO: 3999 - DNA, 27 bp, Artificial Sequence
  Synthetic Construct
cccgctcgaggccgatgtttagcgtcc

SEQ ID NO: 4000 - DNA, 32 bp, Artificial Sequence
  Synthetic Construct
cgcggatcccatatgttttggctgggaacggg

SEQ ID NO: 4001 - DNA, 26 bp, Artificial Sequence
  Synthetic Construct
cccgctcgaggtgagaaaggtcgcgc

SEQ ID NO: 4002 - DNA, 32 bp, Artificial Sequence
  Synthetic Construct
cgcggatcccatatgtgcaccatgattcccca

SEQ ID NO: 4003 - DNA, 28 bp, Artificial Sequence
  Synthetic Construct
gcccaagctttttgtcggtttgggtatc

SEQ ID NO: 4004 - DNA, 28 bp, Artificial Sequence
  Synthetic Construct
cgcggatccgctagcgccgtgccggagg

SEQ ID NO: 4005 - DNA, 23 bp, Artificial Sequence
  Synthetic Construct
cccgctcgagacgggcgcggcag

SEQ ID NO: 4006 - DNA, 37 bp, Artificial Sequence
  Synthetic Construct
ccggaattctacatatgtcgaaacctgtttttaagaa

SEQ ID NO: 4007 - DNA, 32 bp, Artificial Sequence
  Synthetic Construct
cccgctcgagcttcttatcttttttatctttc

SEQ ID NO: 4008 - DNA, 29 bp, Artificial Sequence
  Synthetic Construct
cgcggatcccatatggcctgcggcggcaa

SEQ ID NO: 4009 - DNA, 27 bp, Artificial Sequence
  Synthetic Construct
cccgctcgagtcgcttgcctcctttac

SEQ ID NO: 4010 - DNA, 33 bp, Artificial Sequence
  Synthetic Construct
cgcggatcccatatggccgatacttacggctat

SEQ ID NO: 4011 - DNA, 32 bp, Artificial Sequence
  Synthetic Construct
cccgctcgagtttgagattttgaatcaaagag

SEQ ID NO: 4012 - DNA, 31 bp, Artificial Sequence
  Synthetic Construct
cgcggatcccatatgaagcagcaggcggtca

SEQ ID NO: 4013 - DNA, 27 bp, Artificial Sequence
  Synthetic Construct
cccgctcgagatttccgtagccgaggg

SEQ ID NO: 4014 - DNA, 31 bp, Artificial Sequence
  Synthetic Construct
cgcggatcccatatgcaccacgacggacacg

SEQ ID NO: 4015 - DNA, 25 bp, Artificial Sequence
  Synthetic Construct
cccgctcgaggtcgtcgcggcggga

SEQ ID NO: 4016 - DNA, 31 bp, Artificial Sequence
  Synthetic Construct
cgcggatcccatatggcaaaaaaaccgaaca

SEQ ID NO: 4017 - DNA, 29 bp, Artificial Sequence
  Synthetic Construct
cccgctcgaggaagagtttgtcgagaatt

SEQ ID NO: 4018 - DNA, 31 bp, Artificial Sequence
  Synthetic Construct
cgcggatcccatatggccaatccgcccgaag

SEQ ID NO: 4019 - DNA, 28 bp, Artificial Sequence
  Synthetic Construct
cccgctcgagaaacgcgccaaaatagtg

SEQ ID NO: 4020 - DNA, 30 bp, Artificial Sequence
  Synthetic Construct
cgcggatcccatatgtgcagcagcggaggg

SEQ ID NO: 4021 - DNA, 27 bp, Artificial Sequence
  Synthetic Construct
cccgctcgagttgcttggcggcaaggc

SEQ ID NO: 4022 - DNA, 33 bp, Artificial Sequence
  Synthetic Construct
cgcggatcccatatggacggtgttgtgcctgtt

SEQ ID NO: 4023 - DNA, 29 bp, Artificial Sequence
  Synthetic Construct
cccgctcgagcttacggatcaaattgacg

SEQ ID NO: 4024 - DNA, 31 bp, Artificial Sequence
  Synthetic Construct
cgcggatcccatatgttttggcaactgaccg

SEQ ID NO: 4025 - DNA, 29 bp, Artificial Sequence
  Synthetic Construct
cccgctcgagcaaatcagatgcctttagg

SEQ ID NO: 4026 - DNA, 33 bp, Artificial Sequence
  Synthetic Construct
cgcggatcccatatgtccgaaaacaaacaaaac

SEQ ID NO: 4027 - DNA, 28 bp, Artificial Sequence
  Synthetic Construct
cccgctcgagttcattcgttacctgacc

SEQ ID NO: 4028 - DNA, 30 bp, Artificial Sequence
  Synthetic Construct
ccggaattctagctagcctgaccccttggg

SEQ ID NO: 4029 - DNA, 35 bp, Artificial Sequence
  Synthetic Construct
gcccaagcttttttgattttaattgactatagaac

SEQ ID NO: 4030 - DNA, 27 bp, Artificial Sequence
  Synthetic Construct
cgcggatcccatatgtgccagccgccg

SEQ ID NO: 4031 - DNA, 27 bp, Artificial Sequence
  Synthetic Construct
cccgctcgagtttcaagccgagtatgc

SEQ ID NO: 4032 - DNA, 31 bp, Artificial Sequence
  Synthetic Construct
cgcggatcccatatgtgttcgcccgaacctg

SEQ ID NO: 4033 - DNA, 27 bp, Artificial Sequence
  Synthetic Construct
cccgctcgagctttttccccgccgcaa

SEQ ID NO: 4034 - DNA, 32 bp, Artificial Sequence
  Synthetic Construct
cgcggatcccatatgaacaatctgaccgtgtt

SEQ ID NO: 4035 - DNA, 28 bp, Artificial Sequence
  Synthetic Construct
cccgctcgagtggctcaatcctttctgc

SEQ ID NO: 4036 - DNA, 32 bp, Artificial Sequence
  Synthetic Construct
cgcggatccgctagccgcttcacacacaccac

SEQ ID NO: 4037 - DNA, 29 bp, Artificial Sequence
  Synthetic Construct
cccgctcgagccagttgtagcctattttg

SEQ ID NO: 4038 - DNA, 32 bp, Artificial Sequence
  Synthetic Construct
cgcggatcccatatgctgcctgaagcatggcg

SEQ ID NO: 4039 - DNA, 29 bp, Artificial Sequence
  Synthetic Construct
cccgctcgagttccgcaaataccgtttcc

SEQ ID NO: 4040 - DNA, 31 bp, Artificial Sequence
  Synthetic Construct
cgcggatcccatatgtttttctccgccctga

SEQ ID NO: 4041 - DNA, 28 bp, Artificial Sequence
  Synthetic Construct
cccgctcgagtcgctccctaaagctttc

SEQ ID NO: 4042 - DNA, 30 bp, Artificial Sequence
  Synthetic Construct
cgcggatcccatatgttaagatgccgtccg

SEQ ID NO: 4043 - DNA, 30 bp, Artificial Sequence
  Synthetic Construct
cccgctcgagacgccgacgttttttattaa

SEQ ID NO: 4044 - DNA, 31 bp, Artificial Sequence
  Synthetic Construct
cgcggatcccatatgctgacggaaggggaag

SEQ ID NO: 4045 - DNA, 27 bp, Artificial Sequence
  Synthetic Construct
cccgctcgagtttctgtacagcagggg

SEQ ID NO: 4046 - DNA, 31 bp, Artificial Sequence
  Synthetic Construct
cgcggatcccatatggccccgcaaaaacccg

SEQ ID NO: 4047 - DNA, 29 bp, Artificial Sequence
  Synthetic Construct
cccgctcgagtttcatcccttttttgagc

SEQ ID NO: 4048 - DNA, 30 bp, Artificial Sequence
  Synthetic Construct
cgcggatcccatatgtgcggcagcggcgaa

SEQ ID NO: 4049 - DNA, 28 bp, Artificial Sequence
  Synthetic Construct
cccgctcgaggcgtttgtcgagattttc

SEQ ID NO: 4050 - DNA, 33 bp, Artificial Sequence
  Synthetic Construct
cgcggatcccatatgtccgtatatcgcaccttc

SEQ ID NO: 4051 - DNA, 28 bp, Artificial Sequence
  Synthetic Construct
cccgctcgagcggttctttaggtttgag

SEQ ID NO: 4052 - DNA, 31 bp, Artificial Sequence
  Synthetic Construct
cgcggatcccatatgtttgcggcgttggtgg

SEQ ID NO: 4053 - DNA, 28 bp, Artificial Sequence
  Synthetic Construct
cccgctcgagcaatgccgacatcaaacg

SEQ ID NO: 4054 - DNA, 32 bp, Artificial Sequence
  Synthetic Construct
cgcggatcccatatgtccgtttcacccgttcc

SEQ ID NO: 4055 - DNA, 26 bp, Artificial Sequence
  Synthetic Construct
cccgctcgagtcgtttgcgcacggct

SEQ ID NO: 4056 - DNA, 32 bp, Artificial Sequence
  Synthetic Construct
cgcggatcccatatggcaagaaggtcaaaaac

SEQ ID NO: 4057 - DNA, 28 bp, Artificial Sequence
  Synthetic Construct
cccgctcgagggcgttgttcggatttcg

SEQ ID NO: 4058 - DNA, 30 bp, Artificial Sequence
  Synthetic Construct
cgcggatcccatatgccgtctgaaatgccg

SEQ ID NO: 4059 - DNA, 30 bp, Artificial Sequence
  Synthetic Construct
cccgctcgagatatggaaaagtctgttgtc

SEQ ID NO: 4060 - DNA, 30 bp, Artificial Sequence
  Synthetic Construct
cgcggatcccatatgcccgatttttcgatg

SEQ ID NO: 4061 - DNA, 29 bp, Artificial Sequence
  Synthetic Construct
cccgctcgagaaaatggaacaataccagg

SEQ ID NO: 4062 - DNA, 38 bp, Artificial Sequence
  Synthetic Construct
ccggaattctacatatgttgcactttcaaaggataatc

SEQ ID NO: 4063 - DNA, 30 bp, Artificial Sequence
  Synthetic Construct
cccgctcgagaaaaatgtacaatggcgtac

SEQ ID NO: 4064 - DNA, 34 bp, Artificial Sequence
  Synthetic Construct
ccggaattctagctagccagcgtcagcagcacat

SEQ ID NO: 4065 - DNA, 31 bp, Artificial Sequence
  Synthetic Construct
cccgctcgaggaaactgtaattcaagttgaa

SEQ ID NO: 4066 - DNA, 33 bp, Artificial Sequence
  Synthetic Construct
aaaaaaggtaccatgatgcagcacaatcgtttc

SEQ ID NO: 4067 - DNA, 30 bp, Artificial Sequence
  Synthetic Construct
aaactgcagttaatatcgataggttatatg

SEQ ID NO: 4068 - DNA, 38 bp, Artificial Sequence
  Synthetic Construct
aaaaaagaattccggctcggcattgtgcagatgttgca

SEQ ID NO: 4069 - DNA, 30 bp, Artificial Sequence; identical to SEQ ID NO: 4067
  Synthetic Construct

SEQ ID NO: 4070 - DNA, 33 bp, Artificial Sequence
  Synthetic Construct
cgcggatcccatatgaacaaaatataccgcatc

SEQ ID NO: 4071 - DNA, 29 bp, Artificial Sequence
  Synthetic Construct
cccgctcgagccactgataaccgacagat

SEQ ID NO: 4072 - DNA, 30 bp, Artificial Sequence
  Synthetic Construct
cgcggatcccatatgggcgcgcaacgtgag

SEQ ID NO: 4073 - DNA, 25 bp, Artificial Sequence
  Synthetic Construct
cccgctcgagacgccactgccagcg

SEQ ID NO: 4074 - DNA, 38 bp, Artificial Sequence
  Synthetic Construct
aaagaattcgcagagttagtaggcgttaataaaaatac

SEQ ID NO: 4075 - DNA, 30 bp, Artificial Sequence
  Synthetic Construct
aaactgcagttaatatggttttgtcgttcg

SEQ ID NO: 4076 - DNA, 33 bp, Artificial Sequence
  Synthetic Construct
cgcggatcccatatgtgcgcgtgggaaacttat

SEQ ID NO: 4077 - DNA, 32 bp, Artificial Sequence
  Synthetic Construct
cccgctcgagtcggttttgaaactttggtttt

SEQ ID NO: 4078 - DNA, 35 bp, Artificial Sequence
  Synthetic Construct
aaagaattcgcatttgccggcgactctgccgagcg

SEQ ID NO: 4079 - DNA, 30 bp, Artificial Sequence
  Synthetic Construct
aaactgcagtcagcgatcgagctgctcttt

SEQ ID NO: 4080 - DNA, 32 bp, Artificial Sequence
  Synthetic Construct
aaagaattcgctttccgcgtggccggcggtgc

SEQ ID NO: 4081 - DNA, 39 bp, Artificial Sequence
  Synthetic Construct
aaaaaactgcaggtcgacttattcggcggctttttccgc

SEQ ID NO: 4082 - DNA, 44 bp, Artificial Sequence
  Synthetic Construct
aaaaaagaattccaaatccgtcaaaacgccactcaagtattgag

SEQ ID NO: 4083 - DNA, 36 bp, Artificial Sequence
  Synthetic Construct
aaaaaactgcagttacagtccgtccacgcctttcgc

SEQ ID NO: 4084 - DNA, 29 bp, Artificial Sequence
  Synthetic Construct
cgcggatcccatatggaaacccgccccgc

SEQ ID NO: 4085 - DNA, 28 bp, Artificial Sequence
  Synthetic Construct
cccgctcgagaggttgtgttccaggttg

SEQ ID NO: 4086 - DNA, 30 bp, Artificial Sequence
  Synthetic Construct
cgcggatcccatatgtgccggcaggcggaa

SEQ ID NO: 4087 - DNA, 31 bp, Artificial Sequence
  Synthetic Construct
cccgctcgagtttgaaaatataggtatcagg

SEQ ID NO: 4088 - DNA, 35 bp, Artificial Sequence
  Synthetic Construct
aaagaattcgacagaatcggcgatttggaagcacg

SEQ ID NO: 4089 - DNA, 36 bp, Artificial Sequence
  Synthetic Construct
aaactgcagctatatgcgcggcaggacgctcaacgg

SEQ ID NO: 4090 - DNA, 31 bp, Artificial Sequence
  Synthetic Construct
cgcggatcccatatggcaatgatggcggctg

SEQ ID NO: 4091 - DNA, 28 bp, Artificial Sequence
  Synthetic Construct
cccgctcgagtttggcggcatctttcat

SEQ ID NO: 4092 - DNA, 35 bp, Artificial Sequence
  Synthetic Construct
aaaaaagaattccctgccgaaaaaccggcaccggc

SEQ ID NO: 4093 - DNA, 36 bp, Artificial Sequence
  Synthetic Construct
aaaaaactgcagttatttccccgccttcacatcctg

SEQ ID NO: 4094 - DNA, 33 bp, Artificial Sequence; identical to SEQ ID NO: 3028
  Synthetic Construct

SEQ ID NO: 4095 - DNA, 25 bp, Artificial Sequence
  Synthetic Construct
cccgctcgagcgggcggtattcggg

SEQ ID NO: 4096 - DNA, 30 bp, Artificial Sequence
  Synthetic Construct
cgcggatcccatatgcaccgcgtctgggtc

SEQ ID NO: 4097 - DNA, 27 bp, Artificial Sequence
  Synthetic Construct
cccgctcgagatggtgcgaatgaccga

SEQ ID NO: 4098 - DNA, 35 bp, Artificial Sequence
  Synthetic Construct
aaaaaagaattcttgacggaaatccccgtgaatcc

SEQ ID NO: 4099 - DNA, 36 bp, Artificial Sequence
  Synthetic Construct
aaaaaactgcagtcatttcaagggctgcatcttcat

SEQ ID NO: 4100 - DNA, 31 bp, Artificial Sequence
  Synthetic Construct
gcggatccgctagctgtacggcgatggaggc

SEQ ID NO: 4101 - DNA, 25 bp, Artificial Sequence
  Synthetic Construct
cccgctcgagcaatcccgggccgcc

SEQ ID NO: 4102 - DNA, 34 bp, Artificial Sequence
  Synthetic Construct
cgcggatcccatatgtgttacgcaatattgtccc

SEQ ID NO: 4103 - DNA, 26 bp, Artificial Sequence
  Synthetic Construct
cccgctcgagggacaaggcgacgaag

SEQ ID NO: 4104 - DNA, 34 bp, Artificial Sequence
  Synthetic Construct
cgcggatcccatatgaaacaaatgcttttagccg

SEQ ID NO: 4105 - DNA, 28 bp, Artificial Sequence
  Synthetic Construct
cccgctcgaggccgttgcatttgatttc

SEQ ID NO: 4106 - DNA, 31 bp, Artificial Sequence
  Synthetic Construct
cgcggatcccatatgtgcgcgcaattacctc

SEQ ID NO: 4107 - DNA, 24 bp, Artificial Sequence
  Synthetic Construct
cccgctcgagtctcgtgcgcgccg

SEQ ID NO: 4108 - DNA, 29 bp, Artificial Sequence
  Synthetic Construct
cgcggatcccatatgtgcagccccgcagc

SEQ ID NO: 4109 - DNA, 28 bp, Artificial Sequence
  Synthetic Construct
cccgctcgaggttttttgctgacgtagt

SEQ ID NO: 4110 - DNA, 38 bp, Artificial Sequence
  Synthetic Construct
aaaaaagaattccgcggtttgctcaaaacagggctggg

SEQ ID NO: 4111 - DNA, 36 bp, Artificial Sequence
  Synthetic Construct
aaaaaatctagattaagaaagacggaaactactgcc

SEQ ID NO: 4112 - DNA, 35 bp, Artificial Sequence
  Synthetic Construct
aaaaaagaattcgcaacccatgttttgatggaaac

SEQ ID NO: 4113 - DNA, 36 bp, Artificial Sequence
  Synthetic Construct
aaaaaactgcagttactgcccgacaacaacgcgacg

SEQ ID NO: 4114 - DNA, 44 bp, Artificial Sequence
  Synthetic Construct
aaaaaagaattcgcggatgcgcccgcgattttggatgacaaggc

SEQ ID NO: 4115 - DNA, 36 bp, Artificial Sequence
  Synthetic Construct
aaaaaactgcagtcaaaaccgccaatccgccgacac

SEQ ID NO: 4116 - DNA, 29 bp, Artificial Sequence
  Synthetic Construct
cgcggatcccatatggccgccgtcggcgc

SEQ ID NO: 4117 - DNA, 28 bp, Artificial Sequence
  Synthetic Construct
cccgctcgaggcgttggacgtagttttg

SEQ ID NO: 4118 - DNA, 38 bp, Artificial Sequence
  Synthetic Construct
aaaaaagaattcccggtttacattcaaaccggcgcaac

SEQ ID NO: 4119 - DNA, 36 bp, Artificial Sequence
  Synthetic Construct
aaaaaactgcagttaaaatgtatgctgtacgccaaa

SEQ ID NO: 4120 - DNA, 35 bp, Artificial Sequence
  Synthetic Construct
aaaaaagaattcggttcggcagctgtgatgaaacc

SEQ ID NO: 4121 - DNA, 39 bp, Artificial Sequence
  Synthetic Construct
aaaaaactgcagttaacgcaaaccttggataaagttggc

SEQ ID NO: 4122 - DNA, 32 bp, Artificial Sequence; identical to SEQ ID NO: 3988
  Synthetic Construct

SEQ ID NO: 4123 - DNA, 28 bp, Artificial Sequence
  Synthetic Construct
cccgctcgagtttagaaccgcatttgcc

SEQ ID NO: 4124 - DNA, 33 bp, Artificial Sequence
  Synthetic Construct
cgcggatcccatatggccacctacaaagtggac

SEQ ID NO: 4125 - DNA, 28 bp, Artificial Sequence
  Synthetic Construct
cccgctcgagttgtttggctgcctcgat

SEQ ID NO: 4126 - DNA, 32 bp, Artificial Sequence; identical to SEQ ID NO: 4000
  Synthetic Construct

SEQ ID NO: 4127 - DNA, 26 bp, Artificial Sequence
  Synthetic Construct
cccgctcgaggtgagaaaggtcgcgc

SEQ ID NO: 4128 - DNA, 30 bp, Artificial Sequence
  Synthetic Construct
cgcggatcccatatggccgatgccgttgcg

SEQ ID NO: 4129 - DNA, 27 bp, Artificial Sequence
  Synthetic Construct
gcccaagcttgggtcgtttgttgcgtc

SEQ ID NO: 4130 - DNA, 31 bp, Artificial Sequence; identical to SEQ ID NO: 4014
  Synthetic Construct

SEQ ID NO: 4131 - DNA, 25 bp, Artificial Sequence
  Synthetic Construct
cccgctcgaggtcgtcgcggcggga

SEQ ID NO: 4132 - DNA, 31 bp, Artificial Sequence
  Synthetic Construct
cgcggatcccatatggccacaagcgacgacg

SEQ ID NO: 4133 - DNA, 27 bp, Artificial Sequence
  Synthetic Construct
cccgctcgagccactcgtaattgacgc

SEQ ID NO: 4134 - DNA, 44 bp, Artificial Sequence
  Synthetic Construct
aaaaaagaattcttgactaacagggggggagcgaaattaaaaac

SEQ ID NO: 4135 - DNA, 39 bp, Artificial Sequence
  Synthetic Construct
aaaaaatctagattaaaaataatcataatctacattttg

SEQ ID NO: 4136 - DNA, 35 bp, Artificial Sequence
  Synthetic Construct
aaaaaagaattcatggacggcgcacaaccgaaaac

SEQ ID NO: 4137 - DNA, 39 bp, Artificial Sequence
  Synthetic Construct
aaaaaactgcagttacttcacgcgggtcgccatcagcgt

SEQ ID NO: 4138 - DNA, 31 bp, Artificial Sequence
  Synthetic Construct
cgcggatcccatatggcagcaaaagacgtac

SEQ ID NO: 4139 - DNA, 27 bp, Artificial Sequence
  Synthetic Construct
cccgctcgagcatcatgccgcccatcc

SEQ ID NO: 4140 - DNA, 34 bp, Artificial Sequence
  Synthetic Construct
cgcggatcccatatgttagctgttgcaacaacac

SEQ ID NO: 4141 - DNA, 26 bp, Artificial Sequence
  Synthetic Construct
cccgctcgaggaaccggtagcctacg

SEQ ID NO: 4142 - DNA, 31 bp, Artificial Sequence
  Synthetic Construct
cgcggatcccatatgcccccactggaagaac

SEQ ID NO: 4143 - DNA, 29 bp, Artificial Sequence
  Synthetic Construct
cccgctcgagtaataaaccttctatgggc

SEQ ID NO: 4144 - DNA, 37 bp, Artificial Sequence
  Synthetic Construct
cgcggatcccatatgtctttaaatttacgggaaaaag

SEQ ID NO: 4145 - DNA, 29 bp, Artificial Sequence
  Synthetic Construct
gcccaagctttgatttgcctttccgtttt

SEQ ID NO: 4146 - DNA, 34 bp, Artificial Sequence
  Synthetic Construct
ccggaattctacatatggtccacgcatccggcta

SEQ ID NO: 4147 - DNA, 32 bp, Artificial Sequence
  Synthetic Construct
cccgctcgagtttgaatttgtaggtgtattgc

SEQ ID NO: 4148 - DNA, 30 bp, Artificial Sequence
  Synthetic Construct
cgcggatccgctagcttcagagctcagctt

SEQ ID NO: 4149 - DNA, 28 bp, Artificial Sequence
  Synthetic Construct
cccgctcgagaaacagccatttgagcga

SEQ ID NO: 4150 - DNA, 29 bp, Artificial Sequence
  Synthetic Construct
cgcggatcccatatggacgcgcccgcccg

SEQ ID NO: 4151 - DNA, 28 bp, Artificial Sequence
  Synthetic Construct
cccgctcgagccaaatgcccaaccattc

SEQ ID NO: 4152 - DNA, 34 bp, Artificial Sequence
  Synthetic Construct
cgcggatcccatatggcaatgctgattgaaatca

SEQ ID NO: 4153 - DNA, 26 bp, Artificial Sequence
  Synthetic Construct
cccgctcgaggaacacatcgcgcccg

SEQ ID NO: 4154 - DNA, 32 bp, Artificial Sequence
  Synthetic Construct
cgcggatcccatatgtgcggcagaaaatccgc

SEQ ID NO: 4155 - DNA, 29 bp, Artificial Sequence
  Synthetic Construct
cccgctcgagtctaaacccctgttttctc

SEQ ID NO: 4156 - DNA, 32 bp, Artificial Sequence
  Synthetic Construct
ccggaattctagctagccggcacgccgacgtt

SEQ ID NO: 4157 - DNA, 26 bp, Artificial Sequence
  Synthetic Construct
cccgctcgaggacggcatcgctcagg

SEQ ID NO: 4158 - protein, 588 aa, Artificial Sequence
  Synthetic Construct
MKLPVREFDAVVIGAGGAGMRAALQISQSGQTCALLSKVFPTRSHTVSAQGGITVALGNTHEDNWEWHMYDTVKGSDYIGDQDAIEYMCKTGPEAILELEHMGLPFSRLDDGRIYQRPFGGQSKNFGGEQAARTAAAADRTGHALLHTLYQQNLKNHTTIFSEWYALDLVKNQDGAVVGCTALCIETGEVVYFKARATVLATGGAGRIYQSTTNAHINTGDGVGMAIRAGVPVQDMEMWQFHPTGIAGAGVLVTEGCRGEGGYLLNKHGERFMERYAPNAKDLAGRDVVARSIMIEIREGRGCDGPWGPHAKLKLDHLGKEVLESRLPGILELSRTFAHVDPVKEPIPVIPTCHYMMGGIPTKVTGQALTVNEKGEDVVVPGLFAVGEIACVSVHGANRLGGNSLLDLVVFGRAAGLHLQESIAEQGALRDASESDVEASLDRLNRWNNNRNGEDPVAIRKALQECMQHNFSVFREGDAMAKGLEQLKVIRERLKNARLDDTSSEFNTQRVECLELDNLMETAYATAVSANFRTESRGAHSRFDFPDRDDENWLCHSLYLPESESMTRRSVNMEPKLRPAFPPKIRTY

SEQ ID NO: 4159 - protein, 726 aa, Artificial Sequence
  Synthetic Construct
MLTTFLNSLMMAMTMVTMTAPAQPQMTTVATAIDSNPNKASKDASDPRAYLNEIDGDKAMTWVEAHNLSTVDKLSKDPRYSEYQADALTILQATDRIASPSFARDGMIDNFWQDGTHVQGLWRRTTWESYRSGNPQWRTILDVDALSKAEGKTWVFEGGDCLPPTSNLCLIRLSDGGKDADVVREFDIAKGEFVKEGFVLPEGKQSVTWVDENTIYVTREWTPGEVTSSGYAYVTKVVKRGQSLDQAVEIFRGQKKDVSAERGVLRDIDGKYVMDTSYRGLDFFNTELAFYPNGHPDTRKVVLPLPTTAVFSGYYKGQAIYWLKSDWTSAKGTVFHNGAIIAFDLKAALADPARVEPLVLFMPNEHQSVAGTTQTKNRLVLSILSNVTSEVRSFDFGKGGWSSFKLALPENSTLSLTSSDDESDQLFVFSEGFLEPSTLFCADAATGQVEKITSTPARFDAGGLQAQQFWATSKDGTKVPYFLVARKDVKLDGTNPTILYAYGGFQIPMQPSYSAVLGKLWLEKGGAYALANIRGGGEFGPKWHDAGLKTNRQRVYDDFQAVAQDLIAKKVTSTPHLGIMGGSNGGLLMGVQMIQRPDLWNAVVIQVPLLDMVNFTRMSAGASWQAEYGSPDDPVEGAFLRSISPYHNVKAGVAYPEPFFETSTKDDRVGPVHARKMAALFEDMGLPFYYYENIEGGHAAAANLQEHARRYALEYIYMFQKLMDNK

SEQ ID NO: 4160 - protein, 548 aa, Artificial Sequence
  Synthetic Construct
MSNKPFIYQAPFPMGKDNTEYYLLTSDYVSVADFDGETILKVEPEALTLLAQQAFHDASFMLRPAHQKQVAAILHDPEASENDKYVALQFLRNSEIAAKGVLPTCQDTGTAIIVGKKGQRVWTGGGDEETLSKGVYNTYIEDNLRYSQNAALDMYKEVNTGTNLPAQIDLYAVDGDEYKFLCVAKGGGSANKTYLYQETKALLTPGKLKNFLVEKMRTLGTAACPPYHIAFVIGGTSAETNLKTVKLASAHYYDELPTEGNEHGQAFRDVQLEQELLEEAQKLGLGAQFGGKYFAHDIRVIRLPRHGASCPVGMGVSCSADRNIKAKINREGIWIEKLEHNPGQYIPQELRQAGEGEAVKVDLNRPMKEILAQLSQYPVSTRLSLTGTIIVGRDIAHAKLKELIDAGKELPQYIKDHPIYYAGPAKTPAGYPSGSLGPTTAGRMDSYVDLLQSHGGSMIMLAKGNRSQQVTDACHKHGGFYLGSIGGPAAVLAQQSIKHLECVAYPELGMEAIWKIEVEDFPAFILVDDKGNDFFQQIVNKQCANCTK

SEQ ID NO: 4161 - protein, 346 aa, Artificial Sequence
  Synthetic Construct
MKKLISGIIAVAMALSLAACQKETKVISLSGKTMGTTYHVKYLDDGSITATSEKTHEEIEAILKDVNAKMSTYKKDSELSRFNQNTQVNTPIEISADFAKVLAEAIRLNKVTEGALDVTVGPVVNLWGFGPEKRPEKQPTPEQLAERQAWVGIDKITLDTNKEKATLSKALPQVYVDLSSIAKGFGVDQVAEKLEQLNAQNYMVEIGGEIRAKGKNIEGKPWQIAIEKPTTTGERAVEAVIGLNNMGMASSGDYRIYFEENGKRFAHEIDPKTGYPIQHHLASITVLAPTSMTADGLSTGLFVLGEDKALEVAEKNNLAVYLIIRTDNGFVTKSSSAFKKLTETKE

SEQ ID NO: 4162 - protein, 744 aa, Artificial Sequence
  Synthetic Construct
MVAVRGAHLKENTTFELVSWVESLRQDAKVSSRIEGTYQRCIELAAEQENGPLLLWRGRELVEILVTLSMDADTLIAALLYPLVEGGCYSTDALKEEYSGTILHLVQGVEQMCAISQLKSTAEETAQAAQVDNIRRMLLSMVDDFRCVVIKLAERICNLREVKDQPDEVRRAAAQECANIYAPLANRLGIGQLKWEIEDYAFRYQHPDTYKQIAKQLSERRIDREDYITHFVDDLSDAMKASNIRAEVQGRPKHIYSIWRKMQKKSLEFDELFDVRAVRIVAEELQDCYAALGVVHTKYRHLPKEFDDYVANPKPNGYQSIHTVVLGPEGKTIEIQIRTKQMHEESELGVAAHWKYKEGTASGGAQSAYDEKINWLRKLLAWQEEMSDSGEMLDELRSQVFDDRVYAFTPKGDVVDLPSNATPLDFAYHIHSEVGHRCIGAKVEGRIVPFTYHLQMGDQVEIITQKEPNPSRDWLNPNLGFVTSSRARAKVHAWFRKQDRDKNIIAGKEILEAELVKIHATLKDAQYYAAKRFNVKSPEELYAGIGSGDLRINQVINHINALVNKPTAEEEDQQLLEKLSEASNKQATSHKKPQRDAVVVEGVDNLMTHLARCCQPIPGDDIQGFVTQGRGISVHRMDCEQLEELRHHAPERIIDTVWGGGFVGNYTITVRVTASERNGLLKELTNTLMNEKVKVAGMKSRVDYKKQMSIMDFELELTDLEVLGRVLKRIEQVKDVAEAKRLYG

SEQ ID NO: 4163 - protein, 681 aa, Artificial Sequence
  Synthetic Construct
MSMSNPLLNIQGLPPFSQIKPEHIRPAVEKLIQDCRNTIEQVLKQPHFTWENFILPLTETNDRLNRAWSPVSHLNSVKNSTELREAYQTCLPLLSEYSTWVGQHKGLYNAYLALKNSAEFADYSIAQKKAIENSLRDFELSGIGLSEEKQQRYGEIVARLSELNSQFSNNVLDATMGWEKLIENEAELAGLPESALQAAQQSAESKGLKGYRFTLEIPSYLPVMTYCENRALREEMYRAYATRASEQGPNAGKWDNSKVMEEILTLRVELAKLLGFNTYTELSLATKMAENPQQVLDFLDHLAERAKPQGEKELQELKGYCEKEFGVTELAPWDIGFYSEKQKQHLYAINDEELRPYFPENRVISGLFELIKRIFNIRAVERKGVDTWHKDVRFFDLIDENDQLRGSFYLDLYAREHKRGGAWMDDCIGRKRKLDGSIETPVAYLTCNFNAPIGNKPALFTHNEVTTLFHEFGHGIHHMLTQIDVSDVAGINGVPWDAVELPSQFMENWCWEEEALAFISGHYETGEPLPKEKLTQLLKAKNFQAAMFILRQLEFGIFDFRLHHTFDAEKTNQILDTLKSVKSQVAVIKGVDWARAPHSFSHIFAGGYAAGYYSYLWAEVLSADAYSRFEEEGIFNPITGKSFLDEILTRGGSEEPMELFKRFRGREPQLDALLRHKGIMN

SEQ ID NO: 4164 - protein, 548 aa, Artificial Sequence [sequence omitted]

SEQ ID NO: 4165 - protein, 185 aa, Artificial Sequence
  Synthetic Construct
MKFKTNKLSLNLVLASSLLAASIPAFAVTGDTDQPIHIESDQQSLDMQGNVVTFTGNVIVTQGTIKINADKVVVTRPGGEQGKEVIDGYGKPATFYQMQDNGKPVEGHASQMHYELAKDFVVLTGNAYLQQVDSNIKGDKITYLVKEQKMQAFSDKGKRVTTVLVPSQLQDKNNKGQTPAQKKGN

SEQ ID NO: 4166 - protein, 185 aa, Artificial Sequence
  Synthetic Construct
MLLKSRHRSLHQSGFSMIEVLVALLLISIGVLGMIAMQGKTIQYTADSVERNKAAMLGSNLLESMRASPKALYDVKDQMATQSDFFKAKGSAFPTAPSSCTPLPDAIKDRLGCWAEQVKNELPGAGDLLKSDYYICRSSKPGDCDGKGSMLEIRLAWRGKQGACVNAADSSADTSLCYYTLRVEP

SEQ ID NO: 4167 - protein, 819 aa, Artificial Sequence
  Synthetic Construct
MSKPLPSALNPLAKALLIRHSLRPRHALSRIGMGLALSSALVFQVQAQEWTLDIPAQSMNSALQALAKQTDTQLLYSPEDIGGLRSSALKGRHDLQSSLRILLQGTGLRYQIDGNTVTVTASAAAKDGQIELSATNVNSAGLGETTEGTGSYTTRVTSTATKMNLSIRETPQTITVVTRQRMDDQHLGSMNEVLTQTPGITMSQDGGERFNIYSRGSAINIYQFDGVTTYQDNQTRNMPSTLMDVGLYDRIEIVRGATGLMTGAGDPSAVVNVIRKRPTREFKSHIQAGVGSWDYYRAEADVSGPLTDDGRVRGRFFAAKQDNHTFMDWYTQDRDVLYGVVEADVTDTTVARFGIDRQTYKVNGAPGVPIIYTNGQPTNFSRSTSSDARWGYDDYTTTNYTFGLEQQLAHDWQFKLAAAYMDVDRDSFSSYYSTTTNRSYLELDGSTEISAGIVTAKQHQKGVDATLQGPFQLLGQTHELIVGYNYLEYENKHRGDSGPDVNINFYDWDNQTPKPGDDEIIPGIQYNISNRQSGYFVASRFNLTDDLHLILGARASNYRFDYALWRIGNEPAPYKMVERGVVTPYAGIVYDLTNEQSVYASYTDIFKPQNNVDITGKPLDPEVGKNYELGWKGEFLEGRLNANIALYMVKRDNLAESTNEVVPDSGGLIASRAVDGAETKGVDVELSGEVLPGWNVFTGYSHTRTEDADGKRLTPQLPMDTFRFWNTYRLPGEWEKLTLGGGVNWNSKSTLNFARYNSHVTQDDYFVTSLMARYRINESLAATLNVNNIFDKKYYAGMAGSYGHYGAPRNATVTLRYDF

SEQ ID NO: 4168 - protein, 272 aa, Artificial Sequence
  Synthetic Construct
MKKTVFTCAMIALTGTAAAAQELQTANEFTVHTDLSSISSTRAFLKEKHKAAKHIGVRADIPFDANQGIRLEAGFGRSKKNIINLETDENKLGKTKNVKLPTGVPENRIDLYTGYTYTQTLSDSLNFRVGAGLGFESSKDSIKTTKHTLHSSRQSWLAKVHADLLSQLGNGWYINPWSEVKFDLNSRYKLNTGVTNLKKDINQKTNGWGFGLGANIGKKLGESASIEAGPFYKQRTYKESGEFSVTTKSGDVSLTIPKTSIREYGLRVGIKF

SEQ ID NO: 4169 - protein, 17 aa, Artificial Sequence
  Synthetic Construct
MFKRSVIAMACIFPLSA

SEQ ID NO: 4170 - protein, 17 aa, Artificial Sequence
  Synthetic Construct
MFKRSVIAMACIFALSA

SEQ ID NO: 4171 - protein, 17 aa, Artificial Sequence
  Synthetic Construct
MFKRSVIAMACIVALSA
